United States Patent
Pearson et al.

(10) Patent No.: US 12,502,436 B2
(45) Date of Patent: *Dec. 23, 2025

(54) COVALENT POLYMER-ANTIGEN CONJUGATED PARTICLES

(71) Applicants: COUR PHARMACEUTICALS DEVELOPMENT COMPANY INC., Northbrook, IL (US); THE REGENTS OF THE UNIVERSITY OF MICHIGAN, Ann Arbor, MI (US)

(72) Inventors: Ryan Pearson, Baltimore, MD (US); Daniel Getts, Northbrook, IL (US); John Puisis, Northbrook, IL (US); James Herrmann, Northbrook, IL (US); Lonnie D. Shea, Ann Arbor, MI (US)

(73) Assignees: COUR PHARMACEUTICALS DEVELOPMENT COMPANY INC., Evanston, IL (US); REGENTS OF THE UNIVERSITY OF MICHIGAN, Ann Arbor, MI (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/049,136

(22) Filed: Oct. 24, 2022

(65) Prior Publication Data
US 2023/0338576 A1    Oct. 26, 2023

Related U.S. Application Data

(63) Continuation of application No. 16/064,528, filed as application No. PCT/US2016/068423 on Dec. 22, 2016, now Pat. No. 11,510,996.

(60) Provisional application No. 62/292,098, filed on Feb. 5, 2016, provisional application No. 62/387,183, filed on Dec. 23, 2015.

(51) Int. Cl.
| | | |
|---|---|---|
| *A61K 39/00* | (2006.01) | |
| *A61K 39/385* | (2006.01) | |
| *A61K 47/69* | (2017.01) | |
| *A61P 37/06* | (2006.01) | |
| *A61K 9/00* | (2006.01) | |
| *A61K 9/51* | (2006.01) | |

(52) U.S. Cl.
CPC ...... *A61K 47/6937* (2017.08); *A61K 39/0008* (2013.01); *A61K 39/385* (2013.01); *A61K 47/6933* (2017.08); *A61P 37/06* (2018.01); *A61K 9/0019* (2013.01); *A61K 9/5153* (2013.01); *A61K 2039/577* (2013.01); *A61K 2039/6093* (2013.01)

(58) Field of Classification Search
CPC ............ A61K 39/00; A61K 39/0001; A61K 39/0002; A61K 39/0005; A61K 39/0008; A61K 39/001
See application file for complete search history.

(56) References Cited

U.S. PATENT DOCUMENTS

| | | | |
|---|---|---|---|
| 4,751,180 A | 6/1988 | Cousens et al. | |
| 4,935,233 A | 6/1990 | Bell et al. | |
| 6,281,256 B1 | 8/2001 | Harris et al. | |
| 6,797,738 B2 | 9/2004 | Harris et al. | |
| 6,890,556 B1 | 5/2005 | Segura et al. | |
| 7,029,697 B2 | 4/2006 | Segura et al. | |
| 7,427,602 B1 | 9/2008 | Shea et al. | |
| 7,846,466 B2 | 12/2010 | Shea et al. | |
| 8,476,228 B2 | 7/2013 | Kodra et al. | |
| 11,510,996 B2* | 11/2022 | Pearson | .......... A61P 7/06 |
| 2002/0045672 A1 | 4/2002 | Harris et al. | |
| 2005/0090008 A1 | 4/2005 | Segura et al. | |
| 2006/0002978 A1 | 1/2006 | Shea et al. | |
| 2009/0238879 A1 | 9/2009 | Shea et al. | |
| 2010/0129439 A1 | 5/2010 | Alexis et al. | |
| 2010/0233251 A1 | 9/2010 | Von Andrian et al. | |
| 2011/0293644 A1 | 12/2011 | Anderson et al. | |
| 2012/0076831 A1 | 3/2012 | Miller et al. | |
| 2015/0190485 A1 | 7/2015 | Shea et al. | |
| 2015/0209293 A1* | 7/2015 | Shea | ....... A61K 39/39 424/275.1 |
| 2016/0166664 A1 | 6/2016 | Miller et al. | |

FOREIGN PATENT DOCUMENTS

| | | | |
|---|---|---|---|
| JP | 2011-500569 A | 1/2011 | |
| WO | WO-93/16724 A1 | 9/1993 | |
| WO | WO-94/27634 A1 | 12/1994 | |
| WO | WO-2009051837 A2 * | 4/2009 | ....... A61K 39/00 |
| WO | WO-2010/085509 A1 | 7/2010 | |

(Continued)

OTHER PUBLICATIONS

Arano et al., A novel bifunctional metabolizable linker for the conjugation of antibodies with radionuclides, Bioconjug. Chem., 2(2):71-6 (Mar.-Apr. 1991).
Astete et al., Synthesis and characterization of PLGA nanoparticles, J. Biomater. Sci. Polym. Ed., 17(3):247-89 (2006).
Bach et al., Tolerance to islet autoantigens in type 1 diabetes, Annu. Rev. Immunol., 19:131-61 (2001).
Ben-Nun et al., The rapid isolation of clonable antigen-specific T lymphocyte lines capable of mediating autoimmune encephalomyelitis, Eur. J. Immunol., 11(3):195-9 (1981).
Bruchez et al., Semiconductor nanocrystals as fluorescent biological labels, Science, 281(5385):2013-6 (1998).

(Continued)

*Primary Examiner* — Micah Paul Young
(74) *Attorney, Agent, or Firm* — MARSHALL, GERSTEIN & BORUN LLP

(57) ABSTRACT

The present invention provides compositions comprising tolerizing immune modified particles (TIMPs) and methods for using and making said TIMPs. In particular, carrier polymer is covalently conjugated with antigenic peptide before particle formation, which allows for exquisite control of particle size and antigen encapsulation (e.g., for use in eliciting induction of immunological tolerance).

20 Claims, 27 Drawing Sheets

Specification includes a Sequence Listing.

(56) References Cited

FOREIGN PATENT DOCUMENTS

| WO | WO-2013/192532 A2 | 12/2013 |
| WO | WO-2015/023796 A2 | 2/2015 |

OTHER PUBLICATIONS

Brus, A simple model for the ionization potential, electron affinity, and aqueous redox potentials of small semiconductor crystallites, J. Chem. Physics, 79 (11): 5566 (1983).

Chao et al., Molecular characterization of MHC class II antigens (B1 domain) in the BB diabetes-prone and -resistant rat, Immunogenetics, 29(4):231-4 (Jul. 1989).

Choy, Oral toleragens in rheumatoid arthritis, Curr. Opin. Investig. Drugs, 1(1):58-62 (Sep. 2000).

Etienne et al., Third-order nonlinear optical properties of a cadmiun sulfide-dendrimer nanocomposite, Appl. Phys. Lett., 87:181913 (2005).

Getts et al., Ly6c+ "inflammatory monocytes" are microglial precursors recruited in a pathogenic manner in West Nile virus encephalitis, J. Exp. Med., 205(10):2319-37 (Sep. 2008).

Iglesias et al., T- and B-cell responses to myelin oligodendrocyte glycoprotein in experimental autoimmune encephalomyelitis and multiple sclerosis, Glia, 36(2):220-34 (Nov. 2001).

International Application No. PCT/US2016/068423, International Preliminary Report on Patentability, dated Jun. 26, 2018.

International Application No. PCT/US2016/068423, International Search Report and Written Opinion, dated Apr. 24, 2017.

Joumaa et al., Synthesis of quantum dot-tagged submicrometer polystyrene particles by miniemulsion polymerization, Langmuir, 22(4):1810-6 (2006).

Kang et al., Transactivation by AP-1 is a molecular target of T cell clonal anergy, Science, 257(5073):1134-8 (1992).

Lemon et al., Preparation and Characterization of Dendrimer-Encapsulated CdS Semiconductor Quantum Dots, J. Am. Chem. Soc., 122(51):12886-7 (2000).

Maratea et al., Deletion and fusion analysis of the phage phi X174 lysis gene E, Gene, 40(1):39-46 (1985).

Miller et al., Suppressor T cells generated by oral tolerization to myelin basic protein suppress both in vitro and in vivo immune responses by the release of transforming growth factor beta after antigen-specific triggering, Proc. Natl. Acad. Sci. USA, 89(1):421-5 (1992).

Murphy et al., Genetic construction, expression, and melanoma-selective cytotoxicity of a diphtheria toxin-related alpha-melanocyte-stimulating hormone fusion protein, Proc. Natl. Acad. Sci. USA, 83(21):8258-62 (1986).

Neimeyer, Functional hybrid devices of proteins and inorganic nanoparticles, Angew. Chem. Int. Ed. Eng., 42(47):5796-800 (2003).

Paidassi et al., C1q binds phosphatidylserine and likely acts as a multiligand-bridging molecule in apoptotic cell recognition, J. Immunol., 180(4):2329-38 (Feb. 2008).

Shevach et al., Control of T-cell activation by CD4+ CD25+ suppressor T cells, Immunol. Rev., 182:58-67 (Aug. 2001).

Waggoner, Covalent labeling of proteins and nucleic acids with fluorophores, Methods Enzymol., 246:362-73 (1995).

Waldner et al., Activation of antigen-presenting cells by microbial products breaks self tolerance and induces autoimmune disease, J. Clin. Invest., 113(7):990-7 (Apr. 2004).

Walker et al., The enemy within: keeping self-reactive T cells at bay in the periphery, Nat. Rev. Immunol., 2(1):11-9 (2002).

Getts et al., Microparticles bearing encephalitogenic peptides induce T-cell tolerance and ameliorate experimental autoimmune encephalomylitis, Nat. Biotechnol., 30(12):1217-24 (Nov. 2012).

Maldonado et al., Polymeric synthetic nanoparticles for the induction of antigen-specfic immunological tolerance, Proc. Natl. Acad. Sci., 112(2):E156-E165 (Jan. 2015).

Makadia et al., Poly lactic-co-Glycolic acid (PLGA) as biodegradable controlled drug delivery carriers, Polymers, 3(4):1377-97 (Aug. 2011).

Jin et al., The selective immobilization of curcumin onto the internal surface of mesoporous hollow silica particles by coalent bonding and its controlled release, J. Mater. Chem., 21:3641 (2011).

* cited by examiner

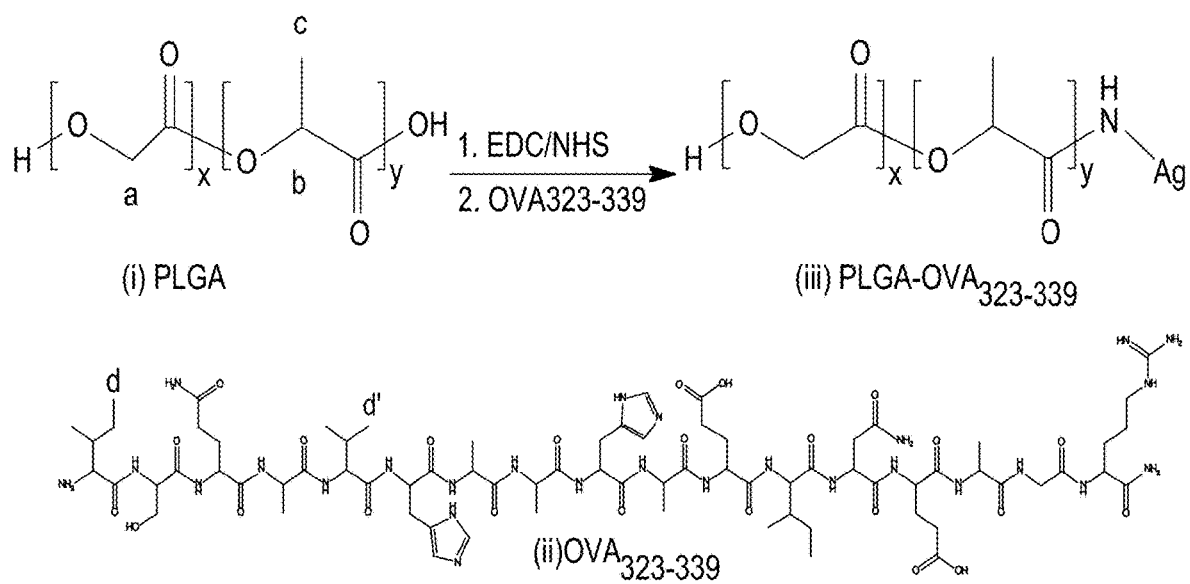
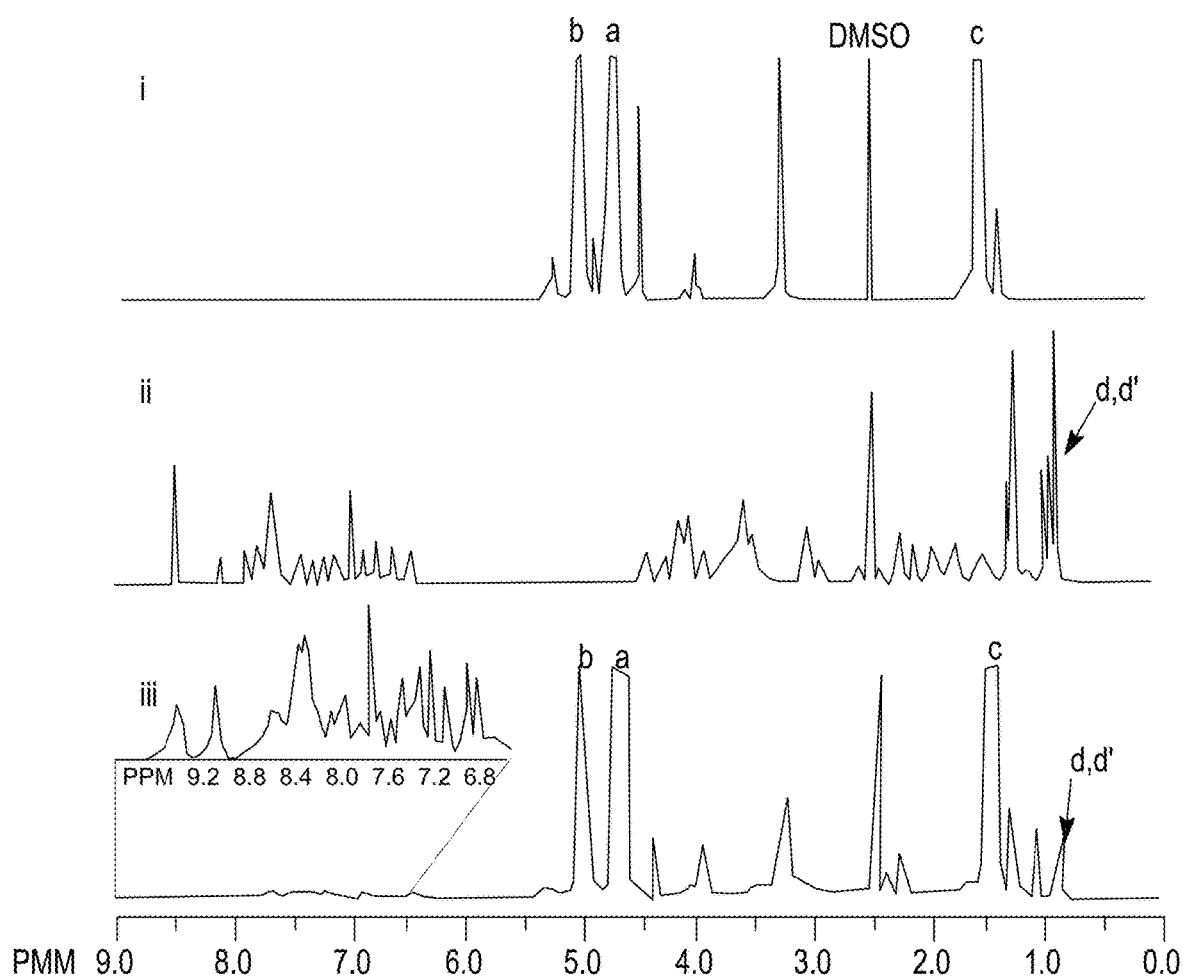
FIG. 2A

| Polymer | Coupling Efficiency |
| --- | --- |
| PLG-PLP$_{139-151}$ | 13.8% |
| PLG-PLP$_{178-191}$ | 28% |
| PLG-OVA$_{323-339}$ | 7.8% |

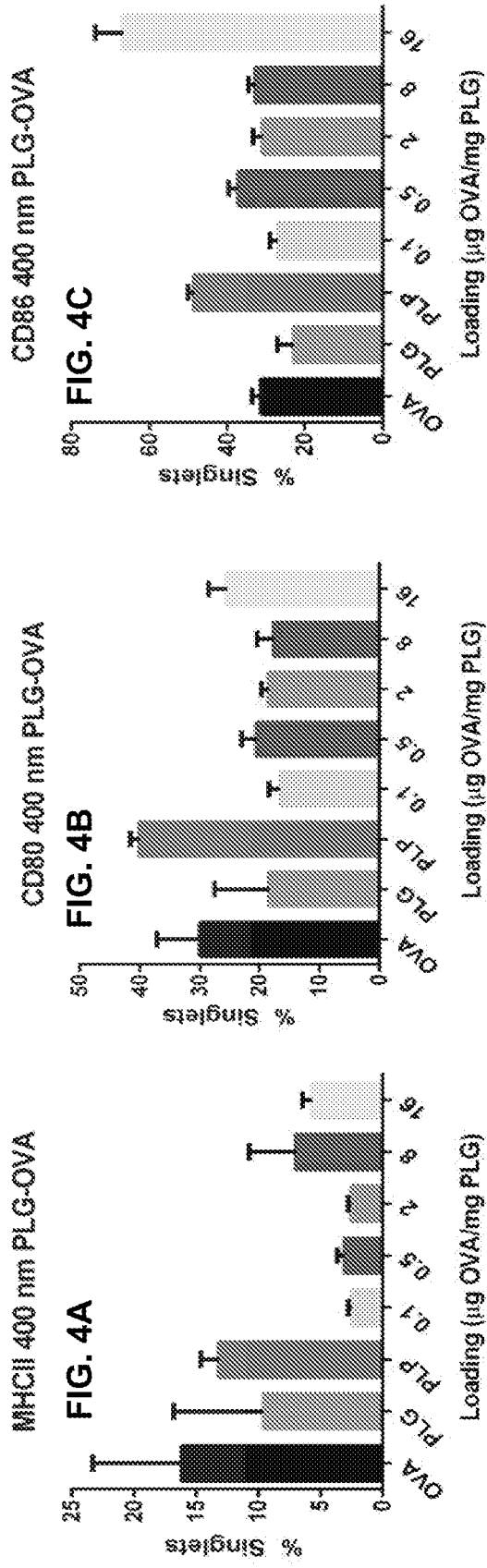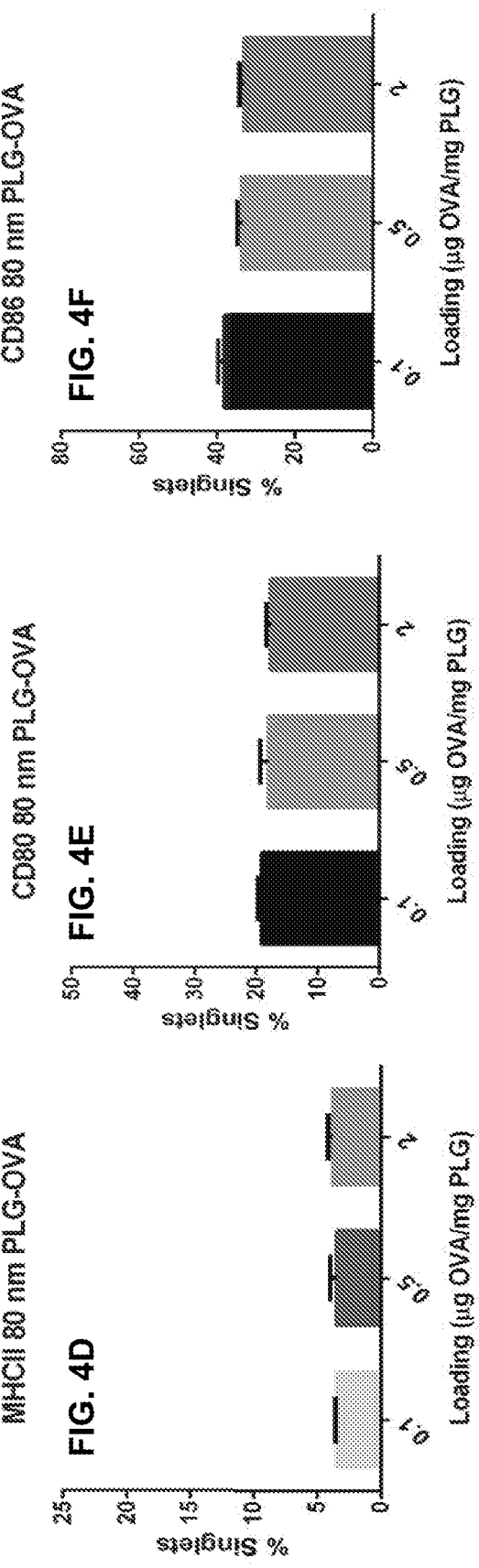

400 nm PLG-OVA particles 8 μg/mg loading

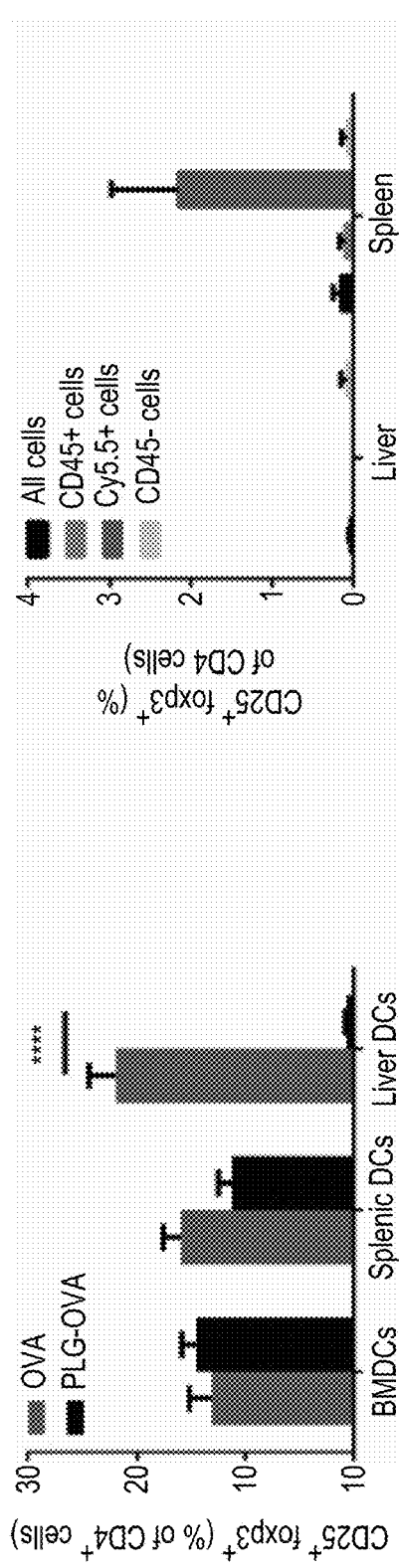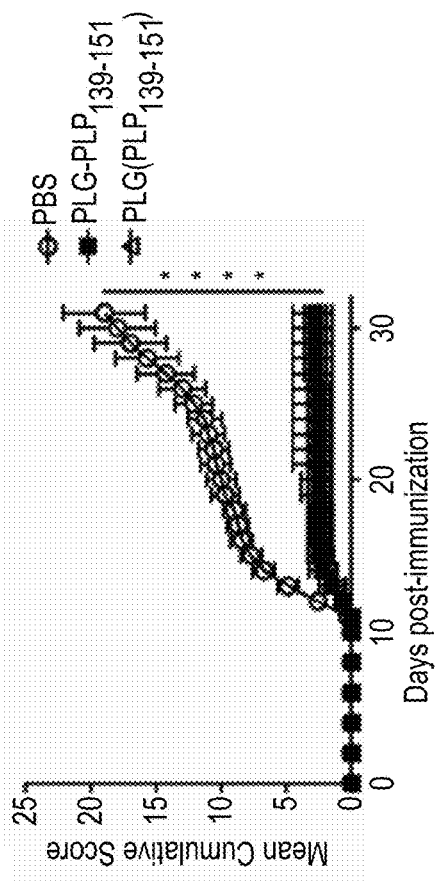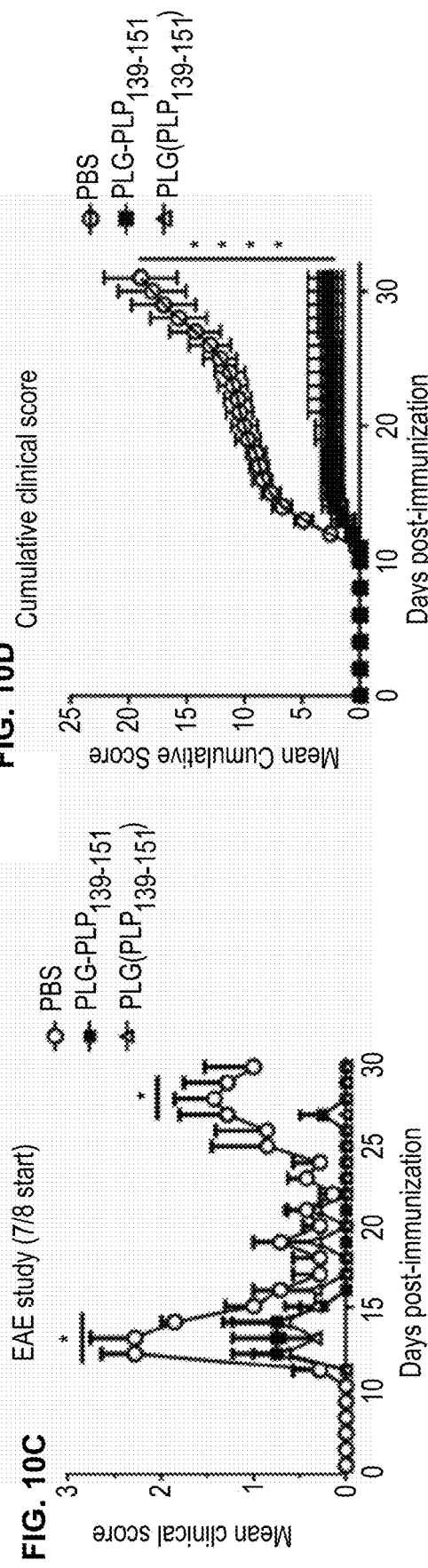
FIG. 10A, FIG. 10B, FIG. 10C, FIG. 10D

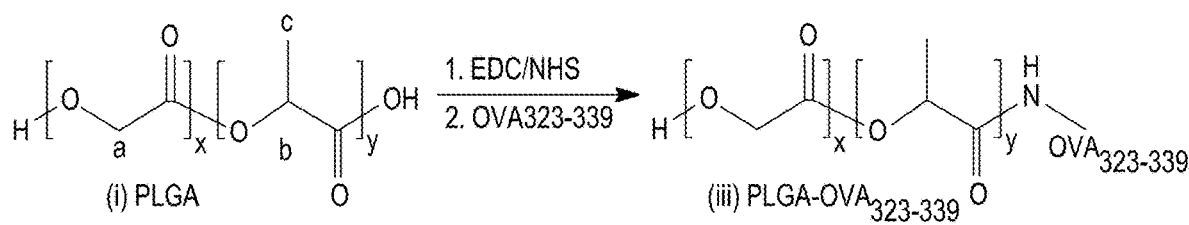
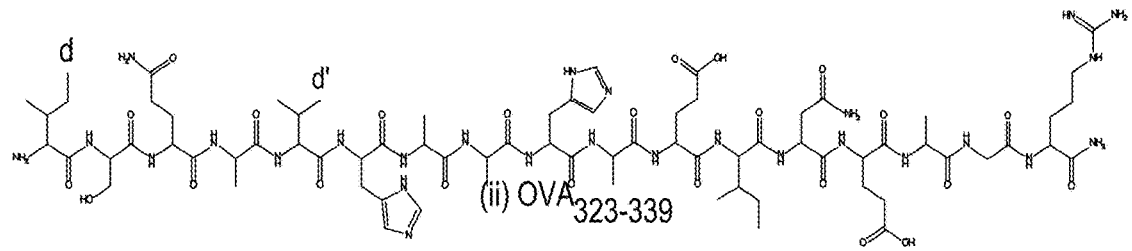
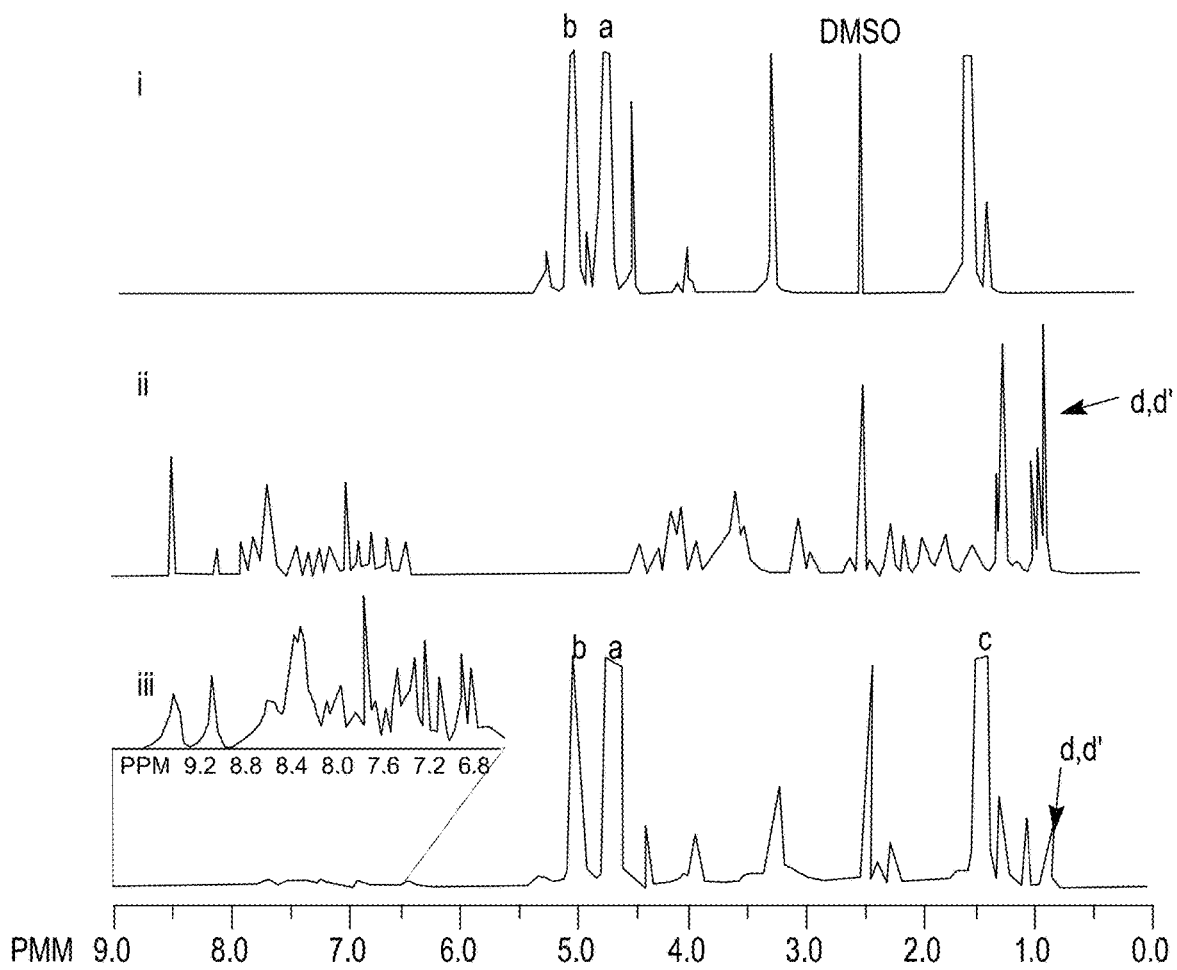
FIG. 11A

| Polymer | Coupling Efficiency |
|---|---|
| PLG-OVA$_{323-339}$ | 66.9% |
| PLG-PLP$_{139-151}$ | 73.6% |
| PLG-PLP$_{178-191}$ | 74.1% |

| 03-23-H1 | | | | | |
|---|---|---|---|---|---|
| 0.552 | 0.524 | 0.503 | AVG | 706.8667 | S.D. 49.16638 |
| 758.2 | 702.2 | 660.2 | | 141.3733 | 9.833277 |
| 151.64 | 140.44 | 132.04 | | | |

Loading ug/mL / ug/mg

| 03-23-H2 | | | | | |
|---|---|---|---|---|---|
| 0.46 | 0.479 | 0.471 | AVG | 594.2 | S.D. 19.07878 |
| 574.2 | 612.2 | 596.2 | | 59.42 | 1.907878 |
| 57.42 | 61.22 | 59.62 | | | | ug/mL / ug/mg

| 03-23-H3 | | | | | |
|---|---|---|---|---|---|
| 0.598 | 0.56 | 0.504 | AVG | 762.2 | S.D. 94.57272 |
| 850.2 | 774.2 | 662.2 | | 38.11 | 4.728636 |
| 42.51 | 38.71 | 33.11 | | | |

Loading ug/mL / ug/mg

| 03-23-L3 | | | | | |
|---|---|---|---|---|---|
| 0.547 | 0.558 | 0.552 | AVG | 758.8667 | S.D. 11.01514 |
| 748.2 | 770.2 | 758.2 | | 379.4333 | 5.507571 |
| 374.1 | 385.1 | 379.1 | | | | ug/mL / ug/mg

FIG. 16 (Continued)

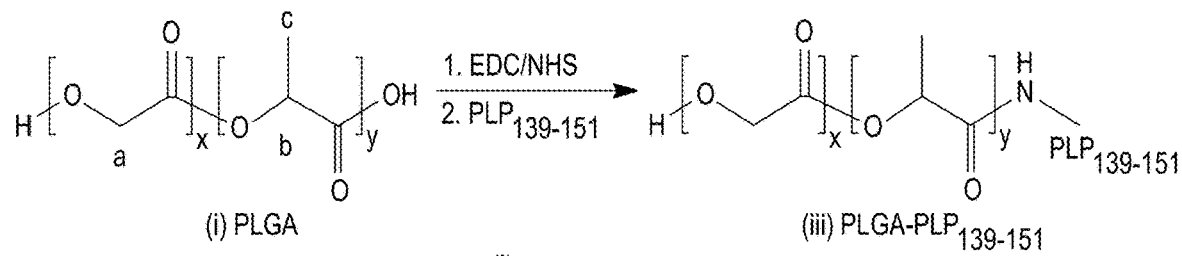
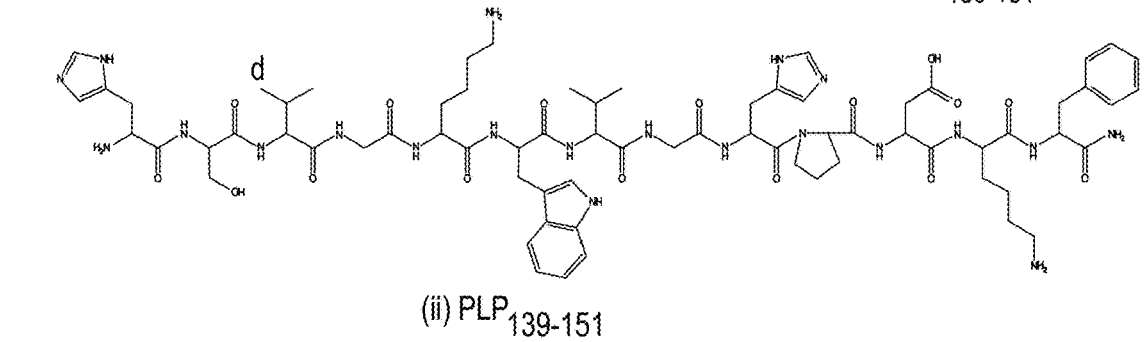
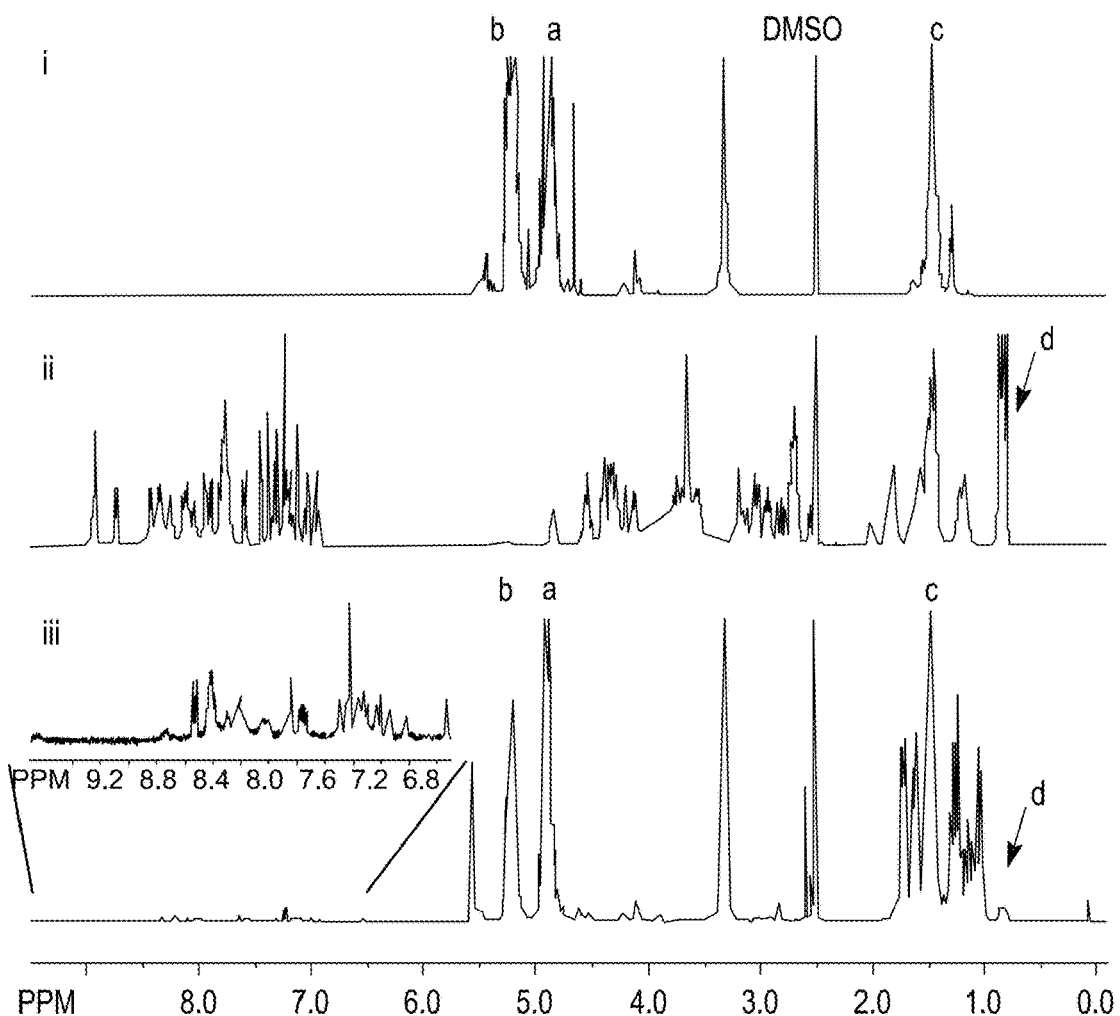
FIG. 19

COVALENT POLYMER-ANTIGEN CONJUGATED PARTICLES

CROSS REFERENCE TO RELATED APPLICATIONS

This application is a continuation of U.S. patent application Ser. No. 16/064,528, filed Jun. 21, 2018, which is a National Stage Application of PCT/US2016/068423, filed Dec. 22, 2016, which claims the benefit of U.S. Provisional Application No. 62/387,183, filed Dec. 23, 2015 and U.S. Provisional Application No. 62/292,098, filed Feb. 5, 2016, the contents of each of which are incorporated herein by reference in their entirety.

STATEMENT OF GOVERNMENT INTEREST

This invention was made with government support under Grant No. EB013198 awarded by the National Institutes of Health. The government has certain rights in the invention.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: 40007A_Seqlist.XML, Created: Oct. 18, 2022, file size 4,665,892 bytes).

BACKGROUND OF INVENTION

Inflammatory diseases and disorders are conditions in which an abnormal or otherwise deregulated inflammatory response contributes to the etiology or severity of disease. Examples include autoimmune diseases such as type 1 diabetes and Celiac disease.

Many of these diseases are characterized by a mononuclear cell infiltration at a site of tissue injury or other insult. Examples of mononuclear cells that have been observed in these infiltrations include lymphocytes, especially T lymphocytes, and cells of the mononuclear phagocyte system (MPS cells) such as monocytes, macrophages, dendritic cells, microglial cells and others.

Many of the cells observed in the mononuclear cell infiltrates are suspected of having a role in these abnormal inflammatory responses. For example, in diseases such as multiple sclerosis, $CD4^+$ T cells are known to play a central role in the pathologic autoimmune response. At an earlier time point in T cell activation, dendritic cells and other MPS cells may be responsible for activation of $CD4^+$ T cells. MPS cells could also contribute to inflammation through phagocytosis although in at least some inflammatory diseases it is not clear whether such cells would be capable of this in the absence of $CD4^+$ T cells.

Peripheral blood monocytes may be classified into one of two groups according to the expression or not of certain cell surface molecules. In particular, human "resident monocytes" or "mature monocytes" are understood to have a $CD14^{lo}CD16^+$ phenotype (the mouse counterpart is $CX3CR1^{hi}CCR2^-Gr1^-$). Another group of cells, the "inflammatory monocytes" or "immature monocytes" are understood to have a $CD14^+CD16^-$ phenotype (the mouse counterpart is $CX3CR1^{lo}CCR2^+Gr1^+$). (Geissmann F. et al. 2003 Immunity 19: 71-82)

Importantly, while the latter are understood to be "inflammatory" in the sense that they are observed to migrate into inflamed tissue from bone marrow derived peripheral blood cells, these cells have not been shown to cause inflammation either directly or through the action of other cells. Further, the various MPS cells that may be formed when these cells differentiate have also not been shown to cause inflammation.

Conventional clinical strategies for general long-term immunosuppression in disorders associated with an undesired immune response are based on the long-term administration of broad acting immunosuppressive drugs, for example, signal 1 blockers such as cyclosporin A (CsA), FK506 (tacrolimus) and corticosteroids. Long-term use of high doses of these drugs can have toxic side-effects. Moreover, even in those patients that are able to tolerate these drugs, the requirement for life-long immunosuppressive drug therapy carries a significant risk of severe side effects, including tumors, serious infections, nephrotoxicity and metabolic disorders.

Methods of inducing antigen-specific tolerance have been developed, including cell coupling of an antigen or peptide. For example, in one method, peptide induced cell coupled tolerance involved collection, separation and treatment of peripheral blood cells with disease specific autoantigens and the ethylene carbodiimide (EDCI) coupling reagent under sterile conditions, and subsequent re-infusion into the donor/patient. This process is costly and must be conducted under closely monitored conditions by skilled practitioners and is limited in the number of centers that can conduct the procedure. The use of red blood cells as the donor cell type expands the potential source to include allogeneic donors thus increasing the supply of source cells dramatically and potentially expanding the delivery of this therapy to any setting certified for blood transfusion. These approaches have significant limitations in terms of supply of source cells and necessity for tissue type matching to minimize immune response to the donor cells. In addition the local treatment of the cells to couple autoantigens via EDCI presents a significant quality control issue. Furthermore, these approaches also require at least some knowledge of the pathological antigen for which immune tolerance is sought.

Antigen-specific tolerance is generally not ideal because specific antigens/epitopes are generally not known in human diseases. Furthermore, antigens can vary from subject to subject. In order for an antigen specific approach to be effective, therefore, it would be necessary to determine which antigens each individual patient would recognize, or it would require coupling a library of possible peptides to the particles prior to administration.

Recently, peptide-coupled particles have been described which eliminates the requirement for a supply of source cells and circumvents the tissue-typing requirement of the prior approaches, See WO 2010/085509; US 2012/0076831; and US 2016/0166664, the contents of which are incorporated by reference herein in their entirety. Notwithstanding, the use of antigens coupled to the outside of particles is associated with increased anaphylaxis and has significant chemistry, manufacturing and control issues.

When the antigen is encapsulated within the particle, these adverse events are avoided, See WO 2013/192532; US 2015/0209293; WO 2015/023796; US 2015/0190485; and US 2015/0283218, the contents of both of which are herein incorporated by reference in their entireties. Further the size and the charge can be altered to enhance tolerance to specific antigens. The problem with antigen encapsulation within nanoparticles, however, is the ability to control the loading of the antigens as well as the release of the antigen. Currently, the amount of antigen goes into each particle cannot be precisely controlled. Similarly, the amount of antigen released is also not tightly controlled leading to the potential for a burst release effect under certain conditions where a slower more controlled release may be desirable. The present invention provides a process where particle size and antigen encapsulation as well as antigen release can be precisely controlled.

SUMMARY OF THE INVENTION

The present disclosure is directed to tolerizing immune modified particles (TIMPs) in which encapsulated antigens are covalently attached to the internal surface. The covalent coupling to the internal particle surface allows for exquisite control of particle size and antigen encapsulation efficiency while at the same time reducing the risk antigen burst effects and avoiding unwanted side effects associated with surface coupled peptides.

The present disclosure provides a composition comprising one or more antigens covalently attached to a carrier particle having a negative zeta potential, wherein said one or more antigens is encapsulated in said particle.

The present disclosure provides a composition comprising one or more antigens encapsulated within a polymeric carrier particle, wherein said one or more antigens is covalently attached to a polymer that makes up said polymeric carrier particle.

In some embodiments, the composition further comprises an unconjugated carrier polymer. In some embodiments, the composition further comprises a pharmaceutically acceptable carrier.

In some embodiments, the present invention provides compositions (e.g., for induction of antigen-specific tolerance) comprising a carrier particle (e.g., PLG particle) covalently attached to one or more antigenic peptides, wherein said one or more antigenic peptides is encapsulated in said carrier particle. In certain embodiments, the carrier particle is a poly(lactide-co-glycolide) (PLG) particle. In other embodiments, the carrier particle is a PLURONIC® stabilized polypropylene sulfide particle.

In some embodiments, the present invention provides compositions comprising: an antigen coupled to a carrier particle having a negative zeta potential. In some embodiments, the zeta potential of the particle is less than about −100 mV. In some embodiments, the zeta potential of the particle is between about −100 mV and about −15 mV. In some embodiments, the zeta potential of the particle is between about −100 mV and about −75 mV. In some embodiments, the zeta potential of the particle is between about −50 mV and about −20 mV. In some embodiments, the particle is a co-polymer having a molar ratio from about 50:50, 80:20 to about 100:0. In some embodiments, the co-polymers ratio may be, but not limited to, polystyrene: poly(vinyl carboxylate)/80:20, polystyrene:poly(vinyl carboxylate)/90:10, poly(vinyl carboxylate):polystyrene/80:20, poly(vinyl carboxylate):polystyrene/90:10, polylactic acid: polyglycolic acid/80:20, or polylactic acid:polyglycolic acid/90:10, or polylactic acid:polyglycolic acid/50:50. Yet in other embodiments, the particle is a polystyrene particle, a carboxylated polystyrene particle, PLURONIC® stabilized polypropylene sulfide particle, or a poly(lactic-co-glycolic acid) particle. In some embodiments, the particle is a poly (lactic-co-glycolic acid) particle.

In some embodiments, the particle has an average diameter of between about 0.1 μm to about 10 μm. In some embodiments, the particle has an average diameter of between 0.2 μm and about 2 μm. In some embodiments, the particle has an average diameter of between about 0.3 μm to about 5 μm. In some embodiments, the particle has an average diameter of between about 0.5 μm to about 3 μm. In some embodiments, the particle has an average diameter of between about 0.5 μm to about 1 μm. In some embodiments, the particle has an average diameter of about 0.5 μm.

In further embodiments, the one or more antigens comprises at least a portion of an autoimmune antigen, allergens, an antigen expressed on a tissue to be transplanted into a subject, an enzyme for enzyme replacement therapy, or an allergen. In some embodiments, the antigen comprises at least a portion of myelin basic protein, acetylcholine receptor, endogenous antigen, myelin oligodendrocyte glycoprotein, pancreatic beta-cell antigen, insulin, proinsulin, islet-specific glucose-6-phosphatase catalytic subunit-related protein (IGRP), glutamic acid decarboxylase (GAD), collagen type 11, human cartilage gp39, fp130-RAPS, proteolipid protein, fibrillarin, small nucleolar protein, thyroid stimulating factor receptor, histones, glycoprotein gp70, pyruvate dehydrogenase dehydrolipoamide acetyltransferase (PCD-E2), hair follicle antigen, aqua porin 4, Desmoglein 1, Desmoglein 3, nicotinic acetylcholine receptor, A-gliaden, and human tropomyosin isoform 5, Bahia grass pollen (BaGP), peach allergen Pru p 3, alpha s 1-Caein Milk allergen, Apig1 celery allergen, Bere1 Brazil nut allergen, B-Lactoglobulin Milk allergen, Bovine serum albumin, Cor a 1.04 Hazelnut allergen, Ovalbumin Egg allergen, Advate, antihemophilic factor, Kogenate, Eloctate, recombinant factor VIII Fc fusion protein, Refacto, Novo VIIa, recombinant factor VII, eptacog alfa, Helixate, Monanine, Coagulation Factor IX, Wilate, Ceredase, Alglucerase, Cerezyme, Imiglucerase, Elelso, taliglucerase alfa, Fabrazyme, Agalsidase beta, Aldurazyme, –I-iduronidase, Myozyme, Acid-glucosidase, Elaprase, iduronate-2-sulfatase, Naglazyme arylsufatase B, or N-acetylgalactosamine-4-sulfatase, proteinaceous therapies used in enzyme or coagluation factor replacement such as myozyme, alglucerase, imiglucerase, taliglucerase, agalsidase beta, 1-iduronidase, acid glucosidase, lduronate-2-sulfatase, N-acetylgalactosamnie-4-sulfatase, antihemophilic factor, factor VII, eptacogalfa, factor IX, miglustat, romiplastim, epotetin alpha, protein C, laronidase, lumizyme, or Factor VIII.

In further embodiments, the one or more antigens comprises an autoimmune antigen, an antigen expressed on a tissue to be transplanted into a subject, an enzyme for enzyme replacement therapy, or an allergen. In non-limiting embodiments, the antigen comprises, for example, myelin basic protein, acetylcholine receptor, endogenous antigen, myelin oligodendrocyte glycoprotein, pancreatic beta-cell antigen, insulin, glutamic acid decarboxylase (GAD), collagen type 11, human cartilage gp39, fp130-RAPS, proteolipid protein, fibrillarin, small nucleolar protein, thyroid stimulating factor receptor, histones, glycoprotein gp70, pyruvate dehydrogenase dehydrolipoamide acetyltransferase (PCD-E2), hair follicle antigen, aqua porin 4, Desmoglein 1, Desmoglein 3, nicotinic acetylcholine receptor, A-gliaden, and human tropomyosin isoform 5, Bahia grass pollen (BaGP), peach allergen Pru p3, alpha s1-Caein Milk allergen, Apig1 celery allergen, Bere1 Brazil nut allergen, B-Lactoglobulin Milk allergen, Bovine serum albumin, Cor a 1.04 Hazelnut allergen, insulin, proinsulin, islet-specific glucose-6-phosphatase catalytic subunit-related protein (IGRP), Ovalbumin Egg allergen, proteinaceous therapies used in enzyme or coagluation factor replacement such as myozyme, alglucerase, imiglucerase, taliglucerase, agalsidase beta, I-iduronidase, acid glucosidase, lduronate-2-sulfatase, N-acetylgalactosamine-4-sulfatase, antihemophilic factor, factor VII, eptacogalfa, factor IX, miglustat, romiplastim, epotetin alpha, protein C, laronidase, lumizyme, or Factor VIII.

In further embodiments, the particles are covalently coupled to one or more antigens comprising one or more epitopes. In a further embodiment, the epitope is associated with an allergy, an autoimmune disease, an enzyme used in enzyme replacement therapy, lysosomal storage disease, or an inflammatory disease or disorder. In one embodiment, the epitope is associated with type 1 diabetes, multiple sclerosis, Systemic Lupus, Neuromyelitis Optica, Idiopathic Thrombocytopenic Purpura, Thrombotic Thrombocytopenic Purpura, Membranous Nephropathy, Bullous Phemphigoid, Phemphigus Vulgaris, Myasthenia Gravis, a mucopolysaccharide storage disorder, gangliosidosis, alkaline hypophosphatasia, cholesterol ester storage disease, hyperuricemia, growth hormone deficiency, renal anemia, Gaucher's disease, Fabry's disease, Hurler's disease, Hunter's disease, Maroteaux-Lamy disease, hemophilia A, hemophilia B, von Wilebrand disease, venous thrombosis, purpura fulminans, mucopolysaccaridosis VI, pompe disease, Celiac's disease, or inflammatory bowel disease, including Crohn's disease or colitis, e.g. ulcerative colitis. In a further embodiment the epitopes are found within proteinaceous therapies used in enzyme or coagulation factor replacement such as myozyme, alglucerase, imiglucerase, taliglucerase, agalsidase beta, 1-iduronidase, acid glucosidase, lduronate-2-sulfatase, N-acetylgalactosamine-4-sulfatase, antihemophilic factor, factor VII, eptacogalfa, factor IX, miglustat, romiplastim, epotetin alpha, protein C, laronidase, lumizyme Factor VIII. In a further embodiment, the epitope is an epitope described in Tables 2 or 3. In one embodiment, the particles are coupled to antigens comprising only one epitope associated with one disease and/or disorder. In a further embodiment, antigens comprise more than one epitope associated with the same disease and/or disorder. In a further embodiment, the antigens comprise more than one epitope associated with different diseases and/or disorders.

In some embodiments, the one or more antigens is covalently coupled to said particle by a conjugate molecule. In some embodiments, the one or more antigens is directly covalently bound to said carrier particle. In some embodiments, the one or more antigens is covalently coupled to said particle by a linker. In some embodiments, the conjugate molecule comprises a carbodiimide compound. In some embodiments, the conjugate molecule comprises 1-Ethyl-3-(3-dimethylaminopropyl)carbodiimide (EDC). In some embodiments, the linkers can include, but are not limited to, a variety of bifunctional protein coupling agents such as N-succinimidyl-3-(2-pyridyldithio)propionate (SPDP), succinimidyl-4-(N-maleimidomethyl)cyclohexane-1-carboxylate, iminothiolane (IT), bifunctional derivatives of imidoesters (such as dimethyl adipimidate HCL), active esters (such as disuccinimidyl suberate), aldehydes (such as glutareldehyde, paraformaldehyde), bis-azido compounds (such as bis (p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene), Biotinylation and streptavidin complexing. Particular coupling agents include N-succinimidyl-3-(2-pyridyldithio)propionate (SPDP) and N-succinimidyl-4-(2-pyridylthio)pentanoate (SPP) to provide for a disulfide linkage.

In some embodiments, the one or more antigens is encapsulated in the particle which has a negative surface zeta potential. In some embodiments, the particle is biodegradable.

In some embodiments, the present invention provides methods of inducing antigen-specific tolerance in a subject comprising: administering to said subject an effective amount of a composition comprising one or more antigens covalently coupled to a carrier particle having a negative zeta potential, wherein said one or more antigens is encapsulated in said particle, and wherein said particle and antigen induce tolerance of said antigen in said subject.

In some embodiments, the present invention provides a method of inducing antigen-specific tolerance in a subject comprising: administering to said subject an effective amount of a composition comprising one or more antigens covalently attached to a carrier particle having a negative zeta potential, wherein said one or more antigens is encapsulated in said particle.

In some embodiments, administering is performed to treat or prevent a disease or condition. In some embodiments, administering is performed prior or subsequent to onset of a disease or condition that is caused by said antigen. In some embodiments, the disease or condition is selected from the group consisting of: an autoimmune disease, inflammatory disease, an allergy, transplantation rejection, a lysosomal storage disease, an enzyme deficiency, inflammatory response and a hyperimmune response. In some embodiments, the disease or condition is selected from the group consisting of: multiple sclerosis, type 1 diabetes, asthma, a food allergy, an environmental allergy, Celiac disease, inflammatory bowel disease, including Crohn's disease or ulcerative colitis, a mucopolysaccharide storage disorder, gangliosidosis, alkaline hypophosphatasia, cholesterol ester storage disease, hyperuricemia, growth hormone deficiency, renal anemia Hemophilia, Hemophilia A, Hemophilia B, von Willebrand disease, Gaucher's Disease, Fabry's Disease, Hurler's Disease, Pompe's Disease, Hunter's Disease, Maroteaux-Lary Disease and a condition caused by said antigen in said subject to reduce overreaction to said antigen. In some embodiments, said composition minimizes or eliminates burst release of said antigen in said subject after administration. In some embodiments, methods further comprise repeating said administration of said composition into said subject.

In a further embodiment, the administration of the particles results in activation induced death of effector T cells.

In a further embodiment, the administration of the particles results in anergy of effector T cells.

In a further embodiment, the administration of particles results in apoptosis of effector T cells.

In a further embodiment, the administration of particles results in the conversion of effector T cells to regulatory T cells.

In a further embodiment, the administration of particles results in the conversion of effector T cells to FOXP3 expressing regulatory T cells.

In a further embodiment, the administration of particles results in the conversion of effector T cells to regulatory T cells devoid of FOXP3 expression.

In a further embodiment, the administration of particles results in the induction and expansion of both antigen specific and non-specific regulatory T cells. In a further embodiment, the administration of particles results in the isolation of effector T cells in the lymph nodes and spleen inhibiting their ability to traffic to peripheral sites and cause inflammation.

In a further embodiment, the administration of particles results in the down regulation of T cell dependent antibody production.

In certain embodiments, the present invention provides methods for treating celiac disease in a subject comprising administering to said subject an effective amount of a composition comprising an antigen covalently coupled to a carrier particle having a negative zeta potential. In certain embodiments, the antigen is gliaden or a gliaden epitope. In some embodiments, the antigen is one or more antigens selected from the group consisting of SEQ ID NOs: 1295-1724, SEQ ID NOs: 1726-1766 and SEQ ID NOs: 4986-5140. In some embodiments, the antigen is gliaden and the antigen-coupled particle has a post-synthesis average size of about 600-1500 nanometers and a post-synthesis average charge of about −30 to about −80 mV. In some embodiments, the particle has a post-synthesis average size of about 600-1200 nanometers and a post-synthesis average charge of about −40 to about −70 mV. In certain embodiments, the particle has a post-synthesis average size of about 600 microns and a post-synthesis average charge of about −50 mV. In further embodiments, the particle is a polystyrene particle, a carboxylated polystyrene particle, a PLURONIC® stabilized polypropylene sulfide particle, or a poly(lactic-co-glycolic acid) particle.

In some embodiments, the present invention provides methods of treating diabetes in a subject comprising administering to said subject an effective amount of a composition comprising an antigen covalently coupled to a carrier particle having a negative zeta potential, wherein said antigen is encapsulated in said particle. In some embodiments, the diabetes is type I diabetes. In some embodiments, the diabetes is type II diabetes.

In some embodiments, the antigen is insulin, proinsulin, islet-specific glucose-6-phosphatase catalytic subunit-related protein (IGRP) or epitopes derived from insulin pro-insulin, or IGRP. In some embodiments, the antigen is one or more antigen selected from the group consisting of ID NOs: 1767-1840, SEQ ID NOs: 1842-1962, SEQ ID NOs: 19642027, SEQ ID NOs: 2029-2073, SEQ ID NOs: 2075-2113, SEQ ID NOs: 2115-2197, SEQ ID NOs: 2199-2248, SEQ ID NOs: 2250-2259, SEQ ID NOs: 2261-2420, SEQ ID NOs: 24222486, and SEQ ID NOs: 2489-2505. In some embodiments, the antigen is insulin and the antigen-coupled particle has a post-synthesis average size of about 300-800 nanometers and a post-synthesis average charge of about −30- to about −70 mV. In some embodiments, the particle has a post-synthesis average size of about 350-600 nanometers and a post-synthesis average charge of about −40 to about −60 mV. In some embodiments, the particle has a post-synthesis average size of about 500 nanometers and a post-synthesis average charge of about −50 mV. In some embodiments, the antigen is pro-insulin and the antigen-coupled particle has a post-synthesis average size of about 300-800 nanometers and a post-synthesis average charge of about −30 to about −70 mV. In certain embodiments, the particle has a post-synthesis average size of about 400-600 nanometers and a post-synthesis average charge of about −40 to about −60 mV. In some embodiments, the particle has a post-synthesis average size of about 570 nanometers and a post-synthesis average charge of about −45 mV. In some embodiments, the antigen is IGRP and the antigen-coupled particle has a post-synthesis average size of about 300-800 nanometers and a post-synthesis average charge of about −30 to about −70 mV. In some embodiments, the particle has a post-synthesis average size of about 400-700 nanometers and a post-synthesis average charge of about −40 to about −60 mV. In some embodiments, the particle has a post-synthesis average size of about 600 nanometers and a post-synthesis average charge of about −40 mV. In certain embodiments, the particle is a polystyrene particle, a carboxylated polystyrene particle, a PLURONIC® stabilized polypropylene sulfide particle, or a poly(lactic-co-glycolic acid) particle.

In some embodiments, the present invention provides methods of treating a subject undergoing enzyme replacement therapy, comprising administering to said subject an effective amount of a composition comprising one or more antigens covalently coupled to a carrier particle having a negative zeta potential, wherein said one or more antigens is encapsulated in said particle. In some embodiments, the subject is undergoing enzyme replacement therapy for treatment of a disease selected from the group consisting of Hemophilia, Hemophilia A, Hemophilia B, von Willebrand disease, a mucopolysaccharide storage disorder, gangliosidosis, alkaline hypophosphatasia, cholesterol ester storage disease, hyperuricemia, growth hormone deficiency, renal anemia Gaucher's Disease, Fabry's Disease, Hurler's Disease, Pompe's Disease, Hunter's Disease, and Maroteaux-Lary Disease. In some embodiments the antigen coupled particle comprises one or more enzyme selected from the group consisting of Advate, antihemophilic factor, Kogenate, Eloctate, recombinant factor VIII Fc fusion protein, Refacto, Novo VIIa, recombinant factor VII, eptacog alfa, Helixate, Monanine, Coagulation Factor IX, Wilate, Ceredase, Alglucerase, Cerezyme, Imiglucerase, Elelso, taliglucerase alfa, Fabrazyme, Agalsidase beta, Aldurazyme, −I-iduronidase, Myozyme, Acid-glucosidase, Elaprase, iduronate-2-sulfatase, Naglazyme arylsufatase B, and N-acetylgalactosamine-4-sulfatase. In some embodiments, the particle is a polystyrene particle, a carboxylated polystyrene particle, a PLURONIC stabilized polypropylene sulfide particle, or a poly(lactic-co-glycolic acid) particle. In certain embodiments, the particle is a co-polymer having a molar ratio from about 80:20 to about 100:0. In certain embodiments, the particle is a polystyrene particle, a carboxylated polystyrene particle, a PLURONIC stabilized polypropylene sulfide particle, or a poly(lactic-co-glycolic acid) particle. In other embodiments, the particle is a poly(lactic-co-glycolic acid) particle and has a copolymer ratio of about 50:50 polylactic acid:polyglycolic acid.

In a further embodiment, the administration of the particles of the invention prevents the accumulation of neutrophils and other granulocytes in a subject. In a further embodiment, the particles of the invention are administered to a subject who has cancer.

In one embodiment, administration of the particles of the invention increases regeneration of damaged tissue. In a further embodiment, the particles increase regeneration of epithelial cells. In yet a further embodiment, the particles increase remyelination of neurons. In another embodiment, the subject has an autoimmune disease. In yet another embodiment, the subject has inflammatory bowel disease, including ulcerative colitis, and/or Crohn's disease. In yet another embodiment, the subject has multiple sclerosis.

In one embodiment, administration of the particles of the invention to a subject minimizes or eliminates burst release of said antigen in said subject after administration.

In some embodiments the composition is administered intravenously. In some embodiments, the composition is administered subcutaneously, orally, intramuscularly, intralymphatically, portally or via aerosol. In one embodiment, administration of the negatively charged particles induces antigen-specific tolerance in a subject. In one embodiment, the particles that induce antigen-specific tolerance comprise one or more epitopes associated with an allergy, autoimmune disease, and/or inflammatory disease. In one embodiment, the epitopes are selected from those described in Tables 2 or 3. In one embodiment, the negatively charged particles are polystyrene, diamond, PLURONIC® stabilized polypropylene sulfide, or poly(lactic-co-glycolic acid) particles. In one embodiment the particles are carboxylated. In one embodiment, the particles have a zeta potential of less than about −100 mV. In some embodiments, the particles have a zeta potential between about −100 mV and about −15 mV. In some embodiments, the particles have a zeta potential between about −100 mV and about −75 mV. In some embodiments, the particles have a zeta potential between about −50 mV and about −20 mV. In one embodiment, the particle has an average diameter of about 0.1 µm to about 10 µm, for example from about 0.2 µm to about 2 µm or about 0.3 µm to about 5 µm, or 0.5 µm to about 3 µm or about 0.5 µm to about 1 µm.

In one embodiment, the subject has an autoimmune disease. In one embodiment, the autoimmune disease is multiple sclerosis, scleroderma, type-I diabetes, rheumatoid arthritis, thyroiditis, systemic lupus erythmatosis, Reynaud's syndrome, Sjorgen's syndrome, autoimmune uveitis, autoimmune myocarditis, inflammatory bowel disease, Amyotrophic Lateral Sclerosis (ALS), Systemic Lupus, Neuromyelitis Optica, Idiopathic Thrombocytopenic Purpura, Thrombotic Thrombocytopenic Purpura, Membranous Nephropathy, Bullous Phemphigoid, Phemphigus Vulgaris, Myasthenia Gravis, Celiac disease, ulcerative colitis, or Crohn's disease. In one embodiment, the particle comprises a full-length polypeptide or fragment thereof. In one embodiment, the particle comprises one or more myelin basic protein epitopes. In one embodiment, the myelin basic protein epitope is from SEQ ID NO: 4975 or SEQ ID NO: 4976. In one embodiment, the particles comprise one or more myelin oligodendrocyte glycoprotein epitopes. In one embodiment, the myelin oligodendrocyte glycoprotein epitope is from SEQ ID NO: 1 or SEQ ID NO: 4978. In one embodiment, the particle contains one or more insulin epitopes. In one embodiment, the one or more insulin epitopes is from SEQ ID NO: 4981. In one embodiment, the particle comprises one or more glutamic acid decarboxylase epitopes. In one embodiment, the glutamic acid decarboxylase epitopes is from SEQ ID NO: 4982. In one embodiment, the particle contains one or more proteolipid protein epitopes. In one embodiment, the proteolipid protein epitope is from SEQ ID NO: 4977. In one embodiment, the particle comprises one or more gliaden epitopes. In one embodiment, the gliaden epitopes comprise SEQ ID NOs: 4983-4985.

In one embodiment, the present invention provides for a method of inducing regulatory T cells comprising treating said T cells with an effective amount of a composition comprising one or more antigens covalently coupled to a carrier particle having a negative zeta potential, wherein said one or more antigens is encapsulated in said particle, and wherein the particle size is greater than 80 nm.

In some embodiments, the present invention further provides a process for the preparation of a tolerizing immune modified particle (TIMP) having a negative zeta potential, said process comprising: a) covalently linking one or more carrier polymers with one or more antigens to form carrier polymer-antigen conjugates; and b) combining carrier polymer-antigen conjugates with unconjugated carrier polymer at predetermined mixing ratios in a solution under conditions effective to form the TIMP, wherein a TIMP having a negative zeta potential is formed, and wherein the one or more antigens is encapsulated in the TIMP.

In some embodiments, the present invention further provides a process for the preparation of a tolerizing immune modified particle (TIMP) having a negative zeta potential, said process comprising: a) covalently linking one or more carrier polymers with one or more antigens to form carrier polymer-antigen conjugates; and b) contacting the carrier polymer-antigen conjugates with a solution under conditions effective to form the TIMP, wherein the TIMP having a negative zeta potential is formed, and wherein the one or more antigens is encapsulated in the TIMP. In some embodiments, the contacting the carrier polymer-antigen conjugates with a solution occurs in the presence of an unconjugated carrier polymer at predetermined mixing ratios.

In some embodiments, the particle created by the process has a zeta potential of less than about −100 mV. In some embodiments, the particle has a zeta potential between about −100 mV and about −15 mV. In some embodiments, the particle has a zeta potential between about −100 mV and about −75 mV. In some embodiments, the particle has a zeta potential between about −50 mV and about −20 mV.

In some embodiments, the particle created by the process has an average diameter of about 0.1 μm to about 10 μm, for example from about 0.2 μm to about 2 μm or about 0.3 μm to about 5 μm, or 0.5 μm to about 3 μm or about 0.5 μm to about 1 μm.

In some embodiments, the particle created by the process comprises a polystyrene particle, a carboxylated polystyrene particle, PLURONIC® stabilized polypropylene sulfide particle, or a poly(lactic-co-glycolic acid) particle. In some embodiments, the particle comprises a poly(lactic-co-glycolic acid) particle.

In some embodiments, the one or more antigens of the process is covalently coupled to said one or more carrier polymers by a conjugate molecule. In some embodiments, the one or more antigens is covalently coupled to said one or more carrier polymers by a linker. In some embodiments, the conjugate molecule comprises a carbodiimide compound. In some embodiments, the conjugate molecule comprises 1-Ethyl-3-(3-dimethylaminopropyl)carbodiimide (EDC).

In some embodiments, the one or more carrier polymers is formed by copolymerization. In some embodiments, the solution is a buffer solution. In some embodiments, the solution has a basic pH. In some embodiments, the solution comprises sodium bicarbonate, potassium bicarbonate, lithium bicarbonate, potassium dihydrogen phosphate, sodium dihydrogen phosphate, or lithium dihydrogen phosphate.

In some embodiments, the TIMPs does not contain other bioactive agents (i.e. drugs, immunomodulators, cytokines). In some embodiments, the TIMP is biodegradable. In some embodiments, the process further comprises formulating said TIMP in a pharmaceutically acceptable carrier.

BRIEF DESCRIPTION OF THE DRAWINGS

FIG. 1 shows the synthesis of PLG-fluorescent dye and PLG-antigen conjugates using EDC/NHS as the coupling reagent.

FIG. 2A-2C show the synthesis and characterization of PLG-peptide conjugates and nanoparticle formation. $^{1}$H-NMR spectrum of (i) PLG, (ii) OVA323-339, and (iii) PLG-OVA323-339 measured in DMSO-d6 (calibrated at 2.5 ppm)(FIG. 2A). The coupling efficiency of OVA323-339, PLP139-151 and PLP178-191 to PLG was calculated by comparing the integration values of the overlapping methyl proton peaks of leucine and isoleucine present at 1.4 ppm in OVA323-339 (d, d') to the methylene proton peak present at 5.3 ppm in PLG (b). (FIG. 2B). A schematic representation of polymer-conjugate nanoparticles is provided in FIG. 2C.

FIG. 3 shows size and time-dependent cellular interactions of PLG nanoparticles. 80 nm and 400 nm PLG nanoparticles were fluorescently labeled with 1% (by wt.) PLG-Cy5.5 conjugate and incubated with bone marrow-derived dendritic cells (BMDCs) or bone marrow-derived macrophages (BMMOs) up to 4 hr at 37° C. Blue: DAPI; Red: PLG-Cy5.5 nanoparticles).

FIG. 4A-4F shows BMDC surface marker characterization after treatment with PLG-OVA323-339 particles having various antigen loadings. (FIG. 4A and FIG. 4D) MHCII marker expression following treatment with 400 nm and 80 nm particles, respectively, (FIG. 4B and FIG. 4E) CD80 marker expression following treatment with 400 nm and 80 nm particles, respectively, (FIG. 4C and FIG. 4F) CD86 marker expression following treatment with 400 nm and 80 nm particles, respectively.

Figure 8A:
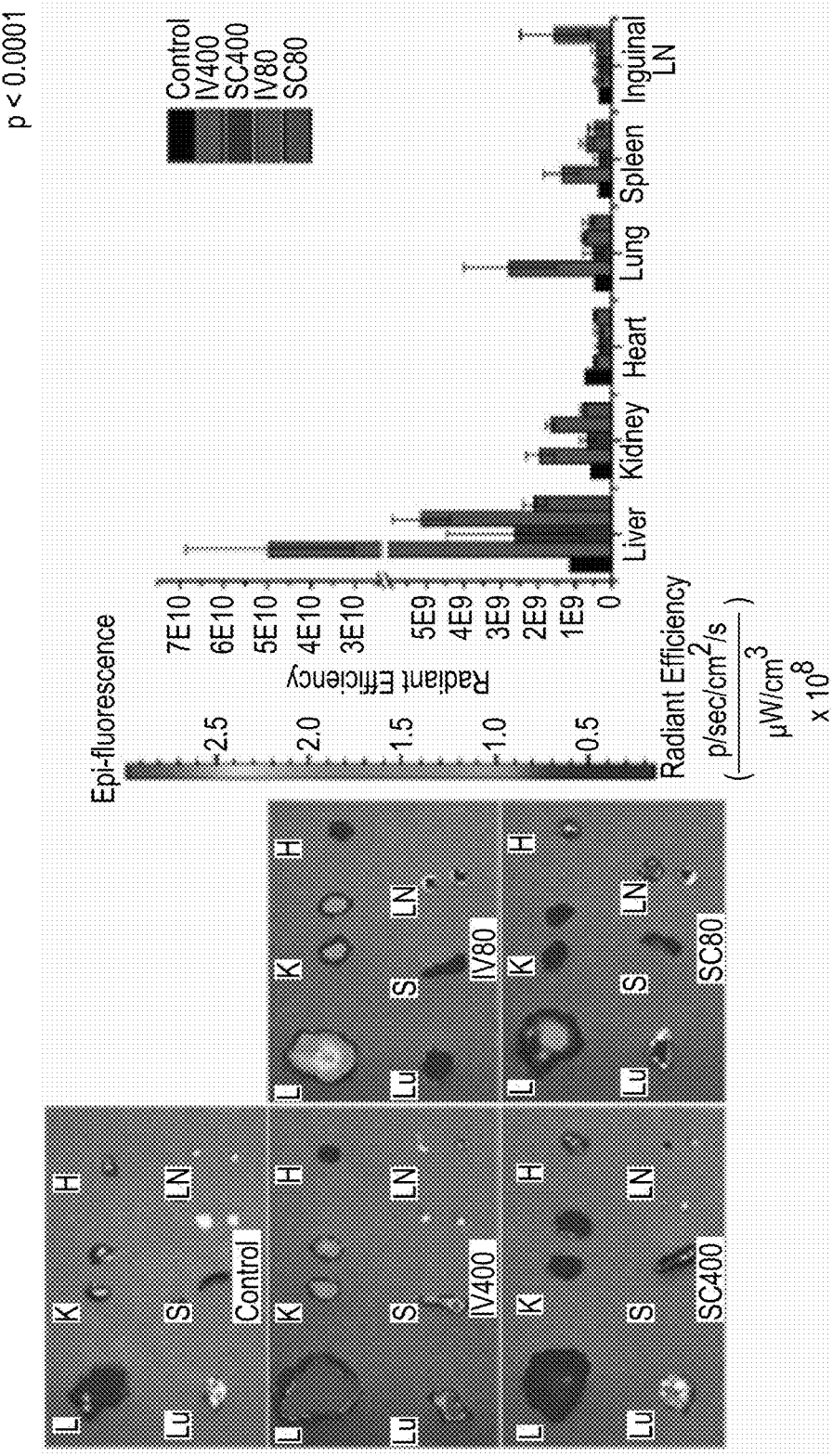
Figure 8C:
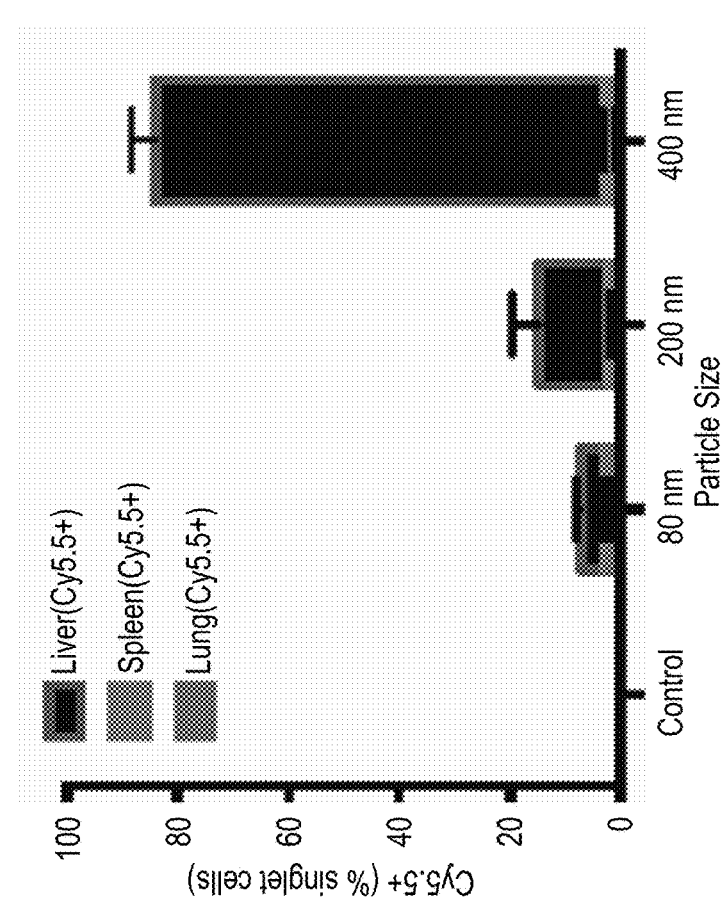
Figure 8B:
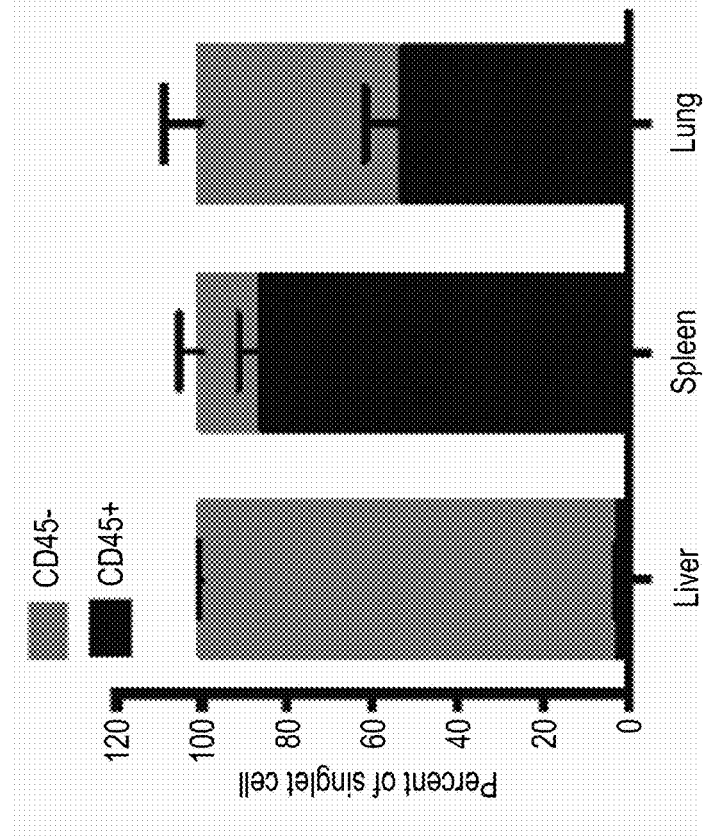
Figure 8E:
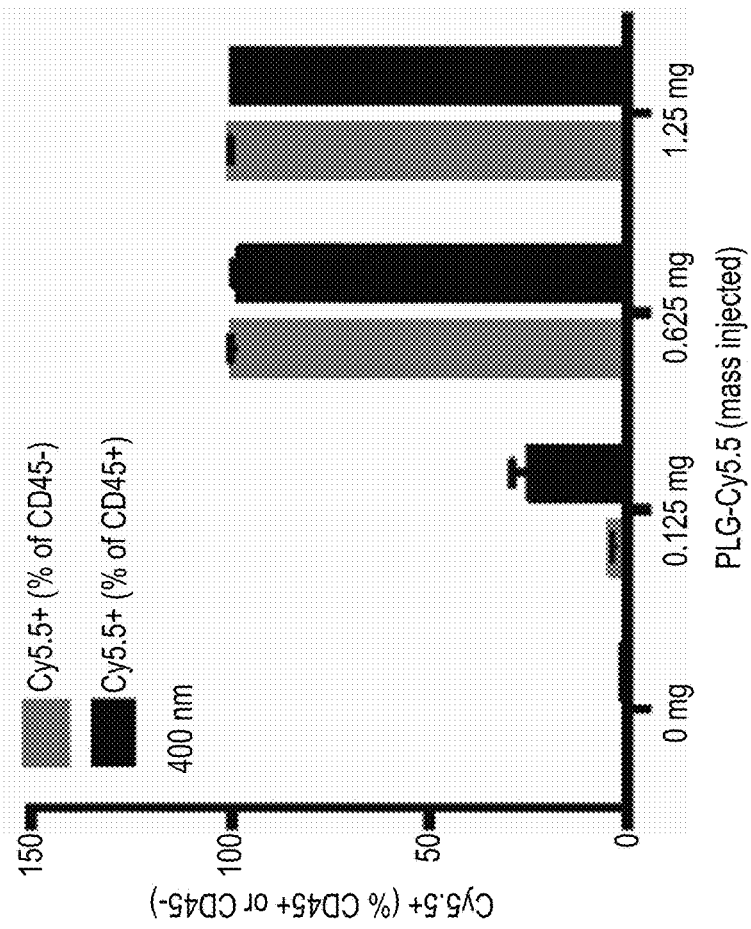
Figure 8D:
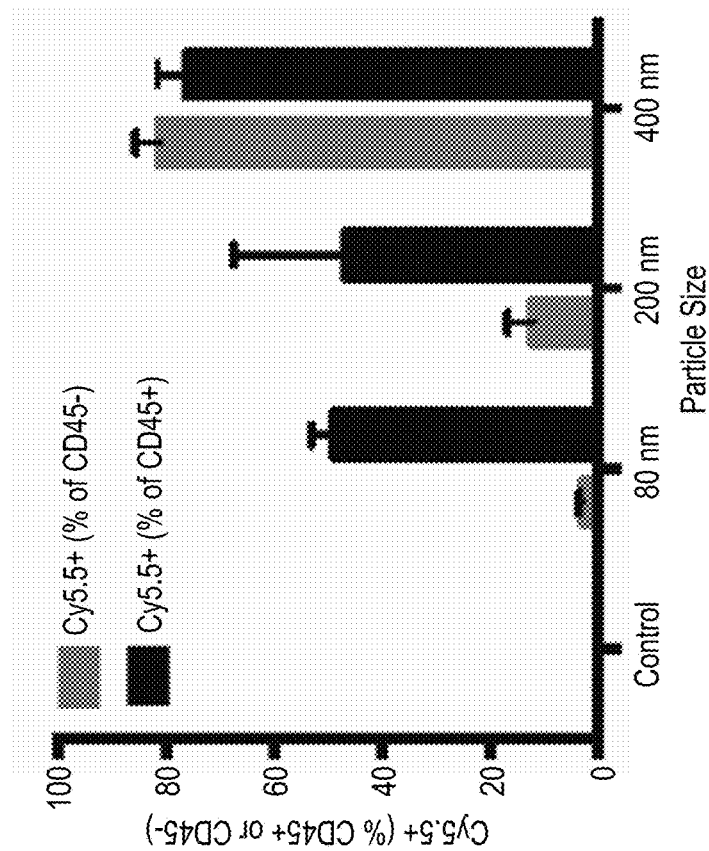

FIG. 8A-8E shows size- and concentration-dependent biodistribution of PLG particles. FIG. 8A, mice were injected either intravenously (IV) or subcutaneously (SC) with 1.25 mg of 400 nm or 80 nm PLG-Cy5.5 nanoparticle formulation. Cells from the liver, kidney, heart, lung, spleen and inguinal lymph nodes were isolated. Data was analyzed by flow cytometry 24 hr after injection. FIG. 8B, the proportion of cells that were CD45+ versus CD45− was determined for liver, spleen and lung. FIG. 8C, mice were injected IV with 1.25 mg of PLG-Cy5.5 nanoparticle formulations of various particle sizes. Data was analyzed by flow cytometry 24 hr after injection. The proportion of Cy5.5+ cells found in the liver, spleen and lung was determined for a given particle size. FIG. 8D, the percentage of either CD45+ or CD45− cells that were Cy5.5+ was determined for a given particle size. FIG. 8E, the percentage of either CD45+ or CD45− cells that were Cy5.5+ was determined for the 400 nm PLG-Cy5.5 particle size.

Figure 9:
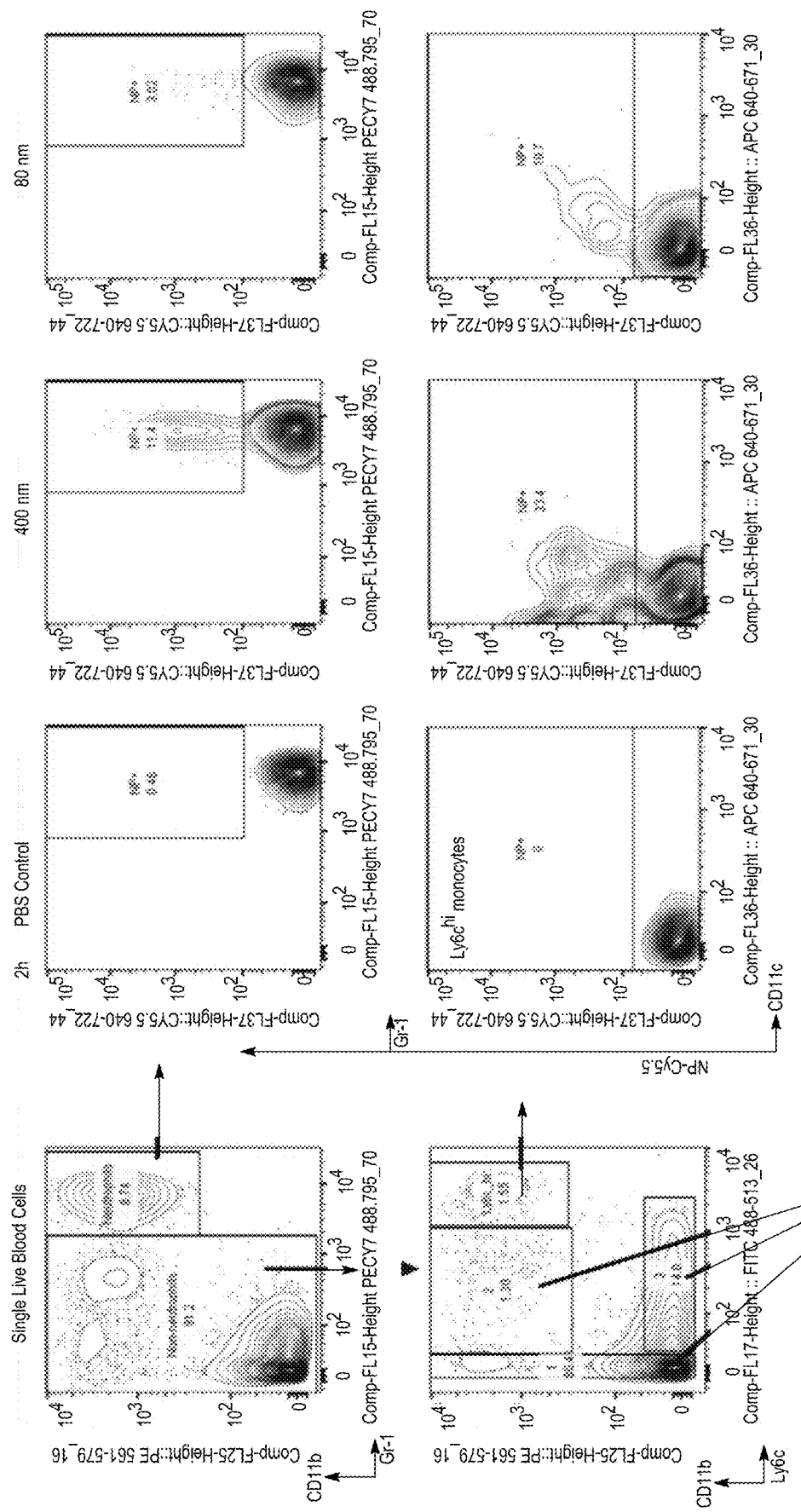
Figure 9:
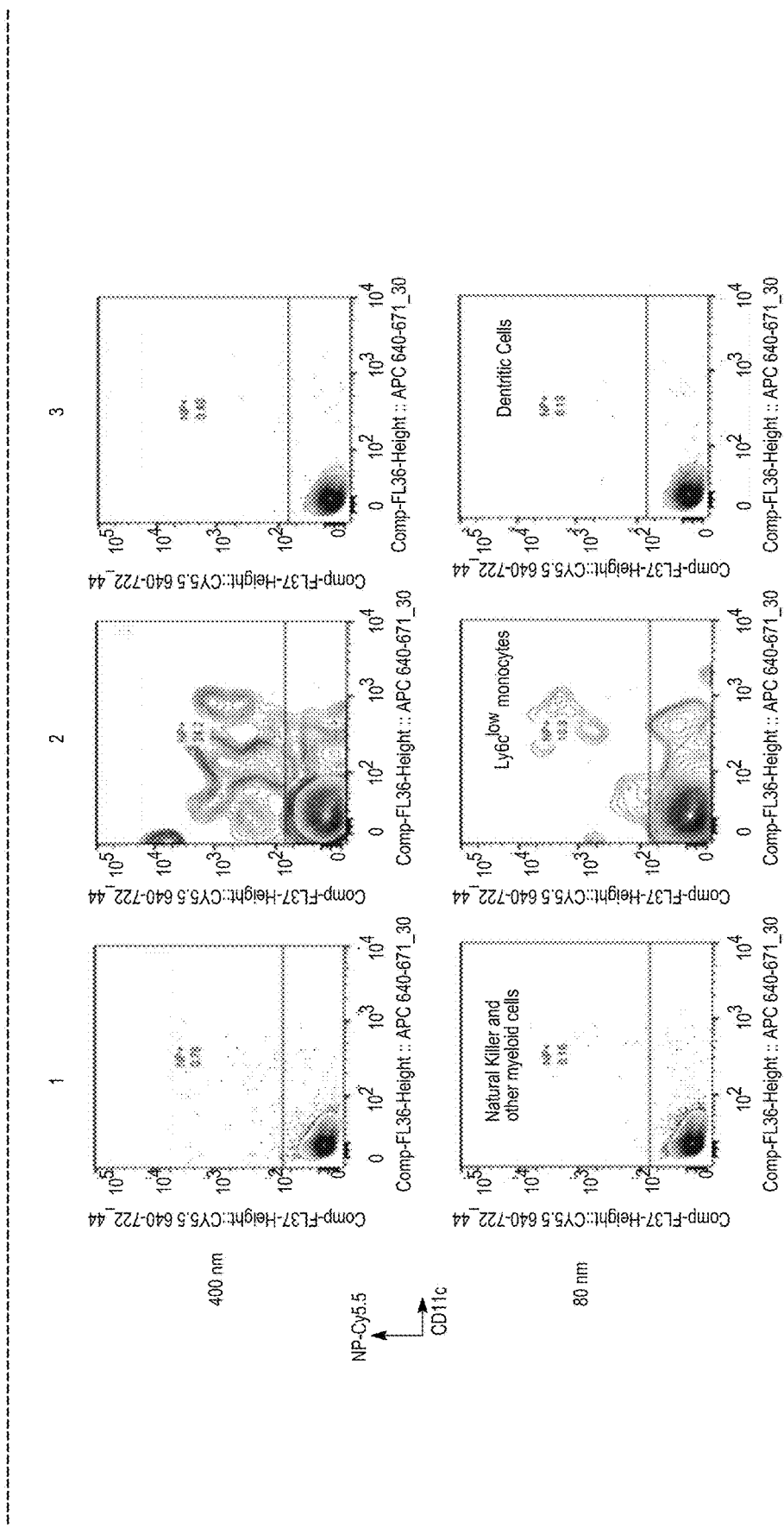

FIG. 9 shows flow cytometric analysis of blood of healthy mice (n=3) injected intravenously with 1.25 mg of 400 nm or 80 nm PLG-Cy5.5 nanoparticle formulation. Blood was collected and analyzed 2 hr after injection. Expression of CD11 b, CD11c, Gr-1 and Ly6c markers were used to identify the types of leukocytes. Cy5.5 fluorescence was used to determine which cells had PLG-Cy5.5 nanoparticles.

FIG. 10A-10D show that PLG particles induce regulatory T cells ex vivo and induce tolerance in experimental autoimmune encephalitis (EAE). BMDCs, splenic dendritic cells or liver dendritic cells were treated for 12-24 hr with 0.1 ug/mL of either OVA alone or 0.1 ug/mL PLG-OVA nanoparticle formulations (0.01-10 μg/mg PLG antigen loading). Flow cytometry was used to measure CD25 activation and foxp3 expression of T cells as indication of induction of regulatory T cells (FIG. 10A). Mice were injected intravenously with 1.25 mg of PLG-Cy5.5 nanoparticle formulations. Flow cytometry was used to measure CD25 activation and foxp3 expression of T cells as indication of induction of regulatory T cells 24 hr after injection (FIG. 10B). The peptides administered to the animals were covalently coupled to particles with a diameter of 200-1200 nm. Mice were treated with either PLP139-151-PLG (N=5) or PBS buffer on day −7 relative to the time of immunization (day 0). Peak disease was typically observed around day 12 to 14, and mice were scored for clinical disease. PBS buffer only did not prevent disease induction. However, PLG particles covalently coupled with PLP139-151 or derived from PLGA covalently linked with antigen produced a clinical score of 0 (no disease) at all except low clinical scores of under 1 exhibited between days 20 and 30 (FIG. 10C). Treatment of mice with nanoparticle formulation resulted in significant abrogated clinical disease scores as measured by cumulative disease scores on days 0-30 post immunization (FIG. 10D). * indicates significance at $p<0.05$.

FIG. 11A-11E show synthesis and characterization of PLG-peptide conjugates and nanoparticle formation. (FIG. 11A) $^1$H-NMR spectrum of (i) PLG, (ii) OVA323-339, and (iii) PLG-OVA323-339 measured in DMSO-d6 (calibrated at 2.5 ppm). (FIG. 11B) The coupling efficiency of OVA323-339 to PLG was calculated by comparing the integration values of the overlapping methyl proton peaks of leucine and isoleucine present at 1.4 ppm in OVA (d, d') to the methylene proton peak present at 5.3 ppm in PLG (b). (FIG. 11C) Schematic representation of antigen-conjugate nanoparticles. (FIG. 11D) PLG, PLG(OVA), PLG-OVA, and acPLG-OVA were incubated with FITC-labeled anti-OVA323-339 IgG to identify the presence of peptide on the surface of the particles. Results are geometric mean fluorescence intensity. (FIG. 11E) Release profile of PLG (OVA323-339) and acPLG-OVA323-339. $p<0.05$.

FIG. 12A-12D show that regulatory T cell induction in vitro is dependent on nanoparticle size and Ag loading. Bone marrow-derived dendritic cells were treated for 3 h with 300 μg/mL of 400 nm (FIG. 12B and FIG. 12D) and 80 nm (FIG. 12C and FIG. 12E) acPLG-OVA323-339 particles. Excess acPLG-OVA323-339 particles were subsequently washed from the wells prior to addition of naïve CD4$^+$OT-II T cells and 2 ng/mL of TGF-β. Cells were co-cultured for 4 days prior to flow cytometric analysis. (FIG. 12A) Representative gating strategy for regulatory T cell induction. Single, live, CD4+ cells were examined for CD25 and Foxp3 expression. (FIG. 12B and FIG. 12C) The effect of antigen loading on CD25 and (FIG. 12D and FIG. 12E) Foxp3 expression of T cells was measured. Although both particle formulations were able to increase CD25 expression similarly, only 400 nm acPLG-OVA323-339 particles could efficiently induce CD4$^+$CD25$^+$Foxp3$^+$ regulatory T cells.

Figure 13B:
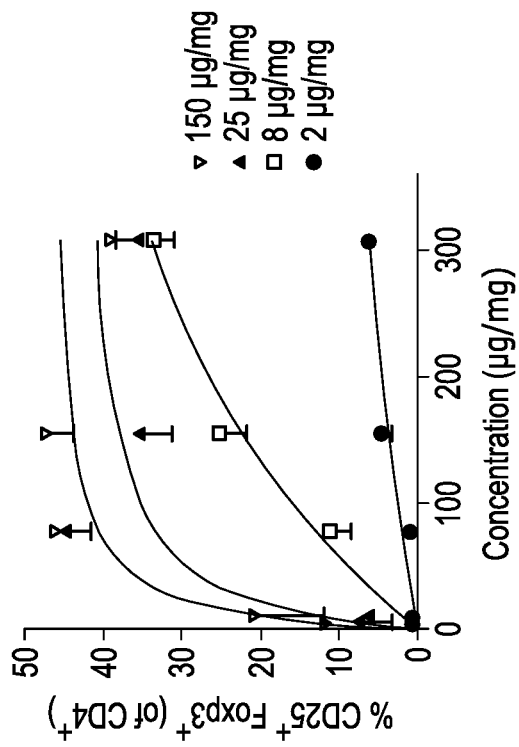
Figure 13A:
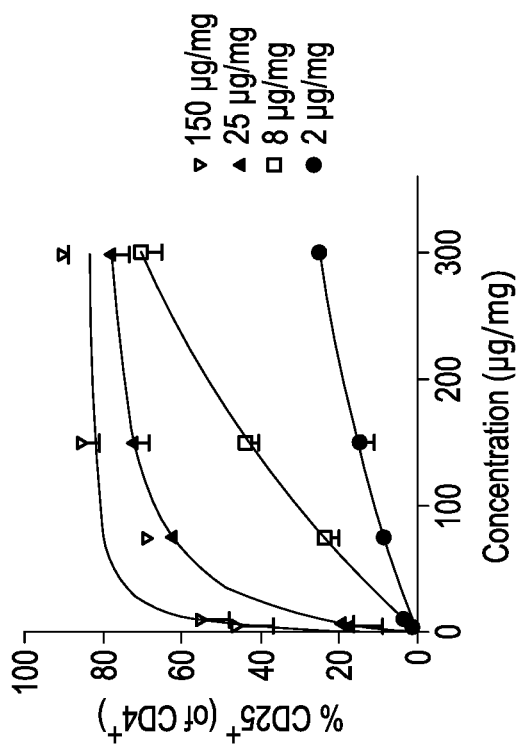

FIG. 13A-13B show that regulatory T cell induction is dependent on nanoparticle concentration. Bone marrow-derived dendritic cells were treated for 3 hr with various concentrations of 400 nm of PLG-OVA nanoparticles (8 μg/mg loading) formulation. Excess acPLG-OVA323-339 particles were subsequently washed from the cell surface prior to addition of OT-II T cells and 2 ng/mL of TGF-β1. The cells were co-cultured for 4 days prior to using flow cytometry to measure CD25 activation (FIG. 13A) and Foxp3 expression (FIG. 13B) of T cells.

Figure 14B:
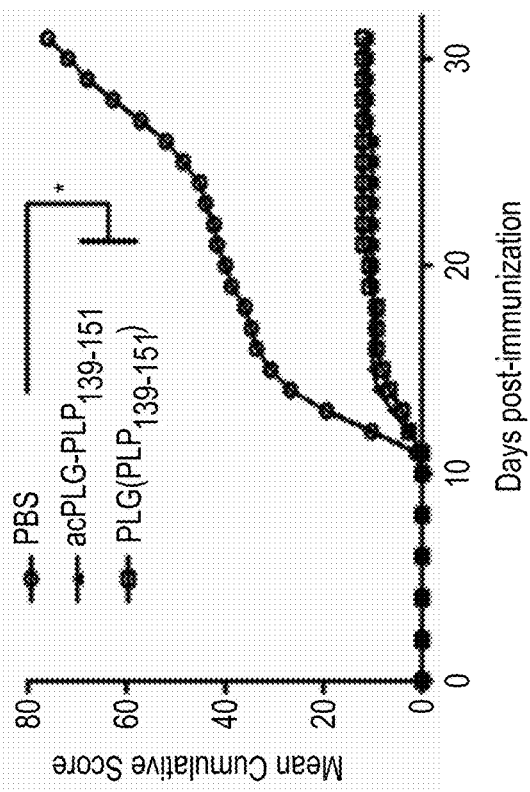
Figure 14A:
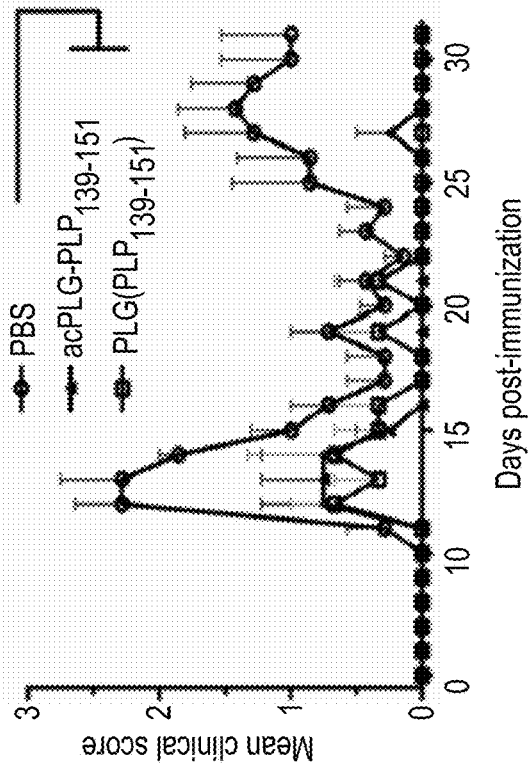

FIG. 14A-14B show that acPLG(Ag) nanoparticles prophylactically induce tolerance in R-EAE. Clinical scores for SJL/J mice treated with PBS (control), 2.5 mg of PLG (PLP139-151) (1.4 μg/mg PLP) or 1.25 mg of acPLG-PLP139-151 (8 μg/mg PLP139-151) and immunized with PLP139-151/CFA to induce R-EAE 7 days later. (FIG. 14A) Treatment of mice with nanoparticle formulations resulted in significantly abrogated clinical disease scores compared to PBS. (FIG. 14B) Corresponding cumulative clinical score for mice treated with tolerogenic particles. (n=3-7).

Figure 15A:
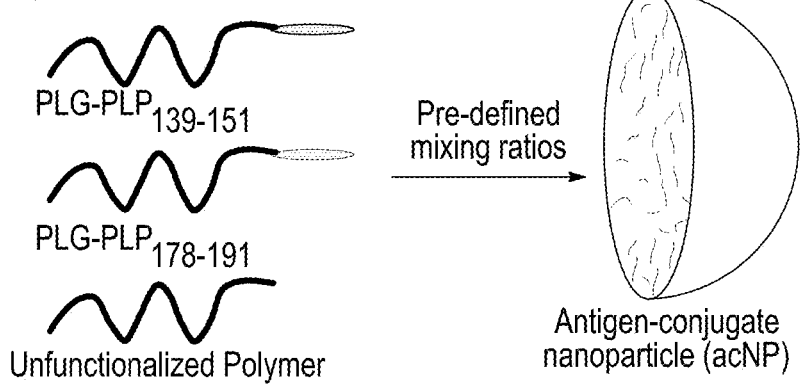
Figure 15B:
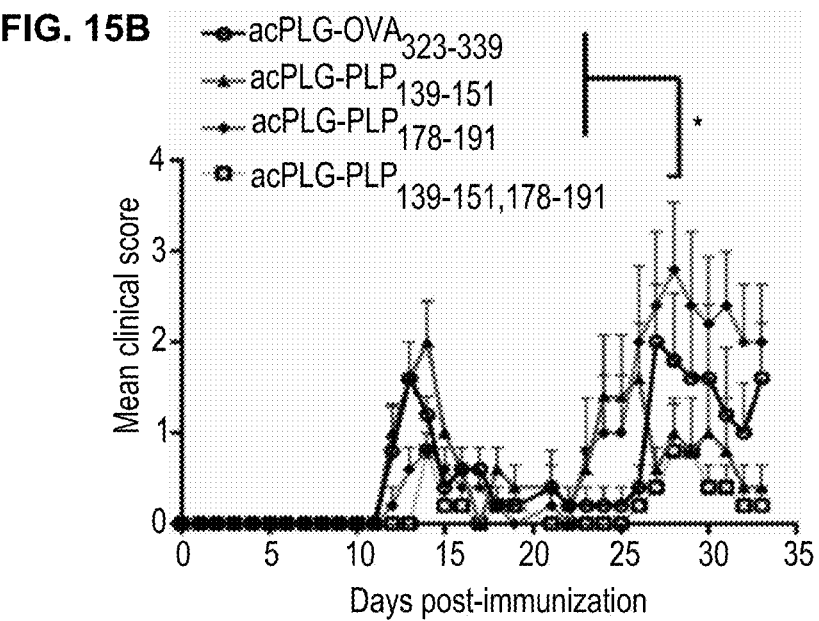
Figure 15C:
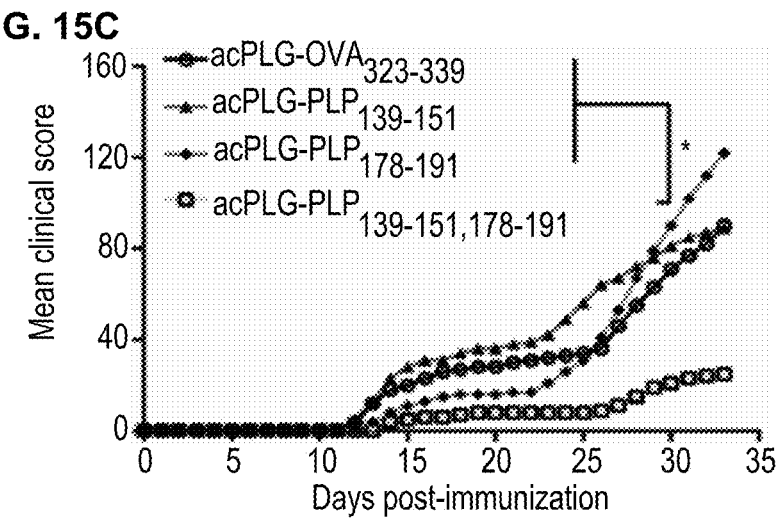

FIG. 15A-15C show that acPLG(Ag) particles induce protective tolerance against R-EAE induced with cocktail of autoantigens. Clinical scores of SJL/J mice treated with 1.25 mg of pcPLG-OVA323-339 (8 μg/mg OVA323-339), pcPLG-PLP139-151 (8 μg/mg PLP139-151), pcPLG-PLP178-191 (8 μg/mg PLP178-191), or pcPLG-PLP139-151,178-191 (8 μg/mg PLP139-151 and 8 μg/mg PLP178-191) and immunized with PLP139-151 and PLP178-191 in CFA to induce R-EAE 7 days later. (FIG. 15A) Schematic representation of antigen-polymer conjugate nanoparticles delivering multiple Ags. (FIG. 15B) Treatment of mice with acPLG nanoparticle formulated with both pathogenic epitopes resulted in significantly abrogated mean clinical disease scores compared to mice treated with only a single or irrelevant epitope. (FIG. 15C) Corresponding cumulative clinical score for mice treated with particles. (n=3-7).

Figure 16:
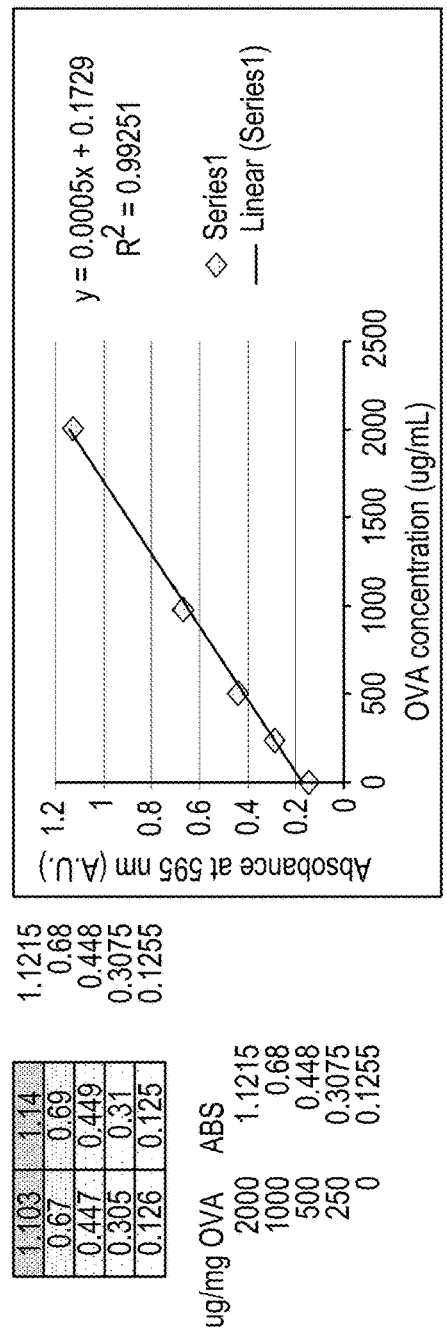

FIG. 16 shows BCA assay raw data for determination of protein content per mg of PLGA-OVA conjugate.

Figure 17:
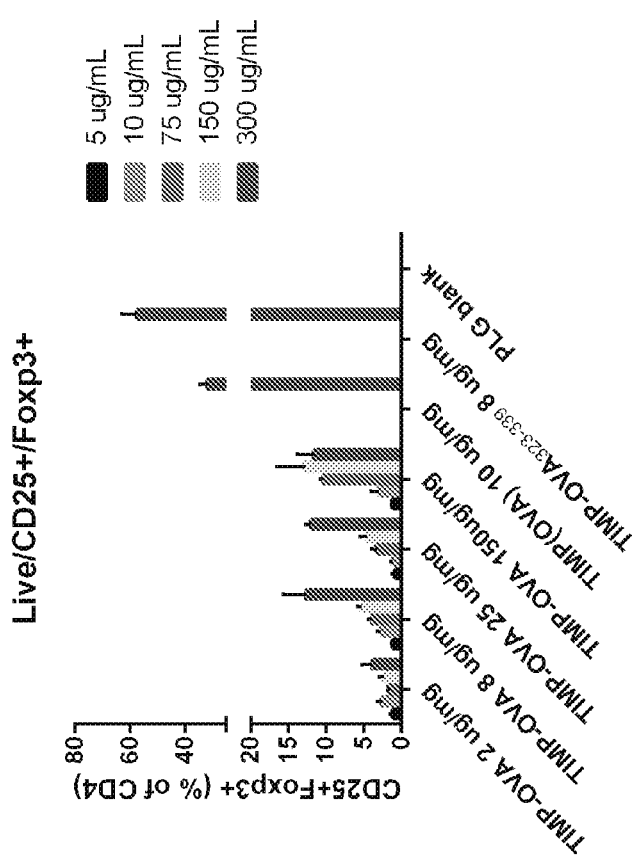

FIG. 17 shows CD25+Foxp3+ cell percentage of CD4+ T cells.

Figure 18:
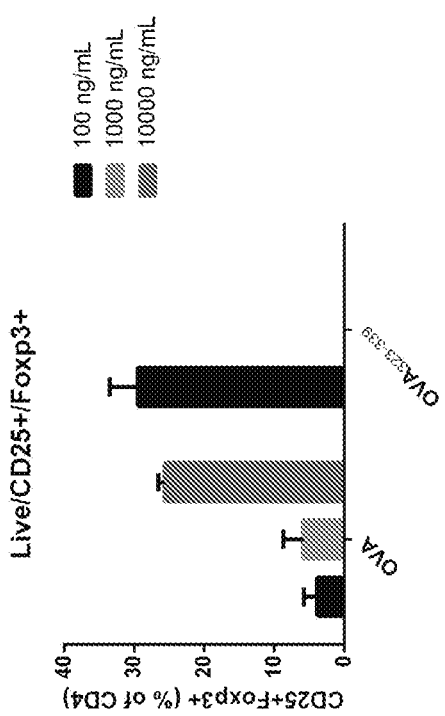

FIG. 18 shows CD25+Foxp3+ cell percentage of CD4+ T cells.

FIG. 19 shows synthesis and characterization of PLGA-PLP139-151 conjugates. $^1$H-NMR spectrum of (i) PLGA, (ii) PLP139-151, and (iii) PLGA-PLP139-151 measured in DMSO-d6 (calibrated at 2.5 ppm).

Figure 20:
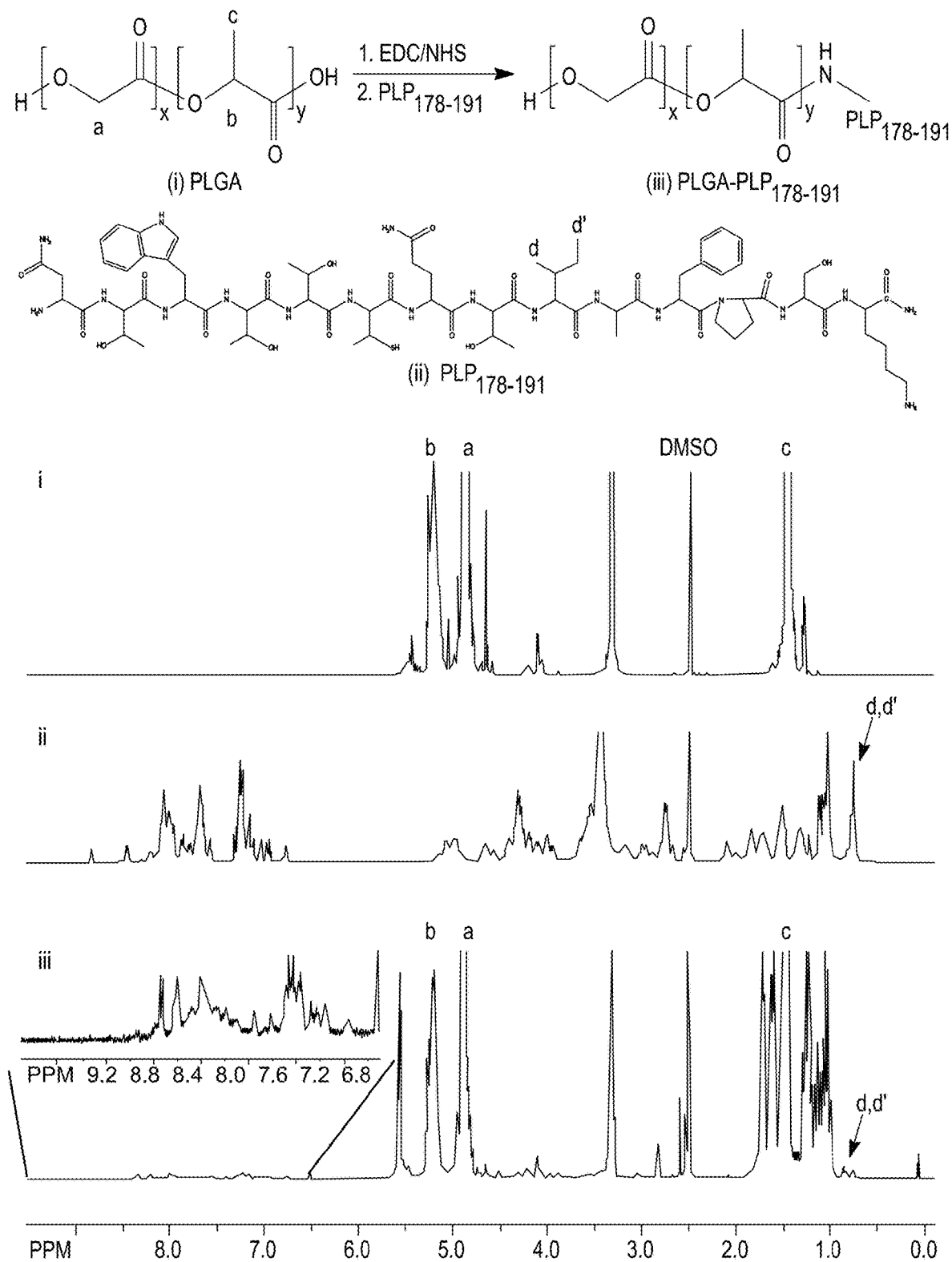

FIG. 20 shows synthesis and characterization of PLGA-PLP178-191 conjugates. $^1$H-NMR spectrum of (i) PLGA, (ii) PLP178-191, and (iii) PLGA-PLP178-191 measured in DMSO-d6 (calibrated at 2.5 ppm).

DETAILED DESCRIPTION OF THE INVENTION

The present inventors have found that tolerizing immune modified particles (TIMPs) in which encapsulated antigens are covalently linked to the internal surface of the particles allow for exquisite control of particle size and antigen encapsulation and reduction of antigen burst effects while still avoiding the unwanted side effects associated with surface coupled peptides. The process for producing such TIMPs comprises covalently coupling one or more antigens to one or more carrier polymers to form carrier polymer-antigen conjugates, followed by combining carrier polymer-antigen conjugates with unconjugated carrier polymer at predetermined mixing ratios in a solution under conditions effective to form TIMPs, with one or more antigens encapsulated therein. These TIMPs can induce tolerance to autoimmune disease and decrease the immune response. These particles, therefore, may be useful in the treatment of any disease or condition characterized by an excessive inflammatory immune response, such as autoimmune diseases or allergies. These TIMPs can minimize or eliminate burst release of one or more antigens from the particle. Minimizing or eliminating burst release of an antigen may be desirable, for example, to better control the amount of antigen released during treatment, to avoid toxic levels of the antigen, and/or to avoid ineffective antigen delivery.

As used herein and in the appended claims, the singular forms "a," "an," and "the" include plural reference unless the context clearly indicates otherwise.

It is understood that aspects and embodiments of the invention described herein include "comprising," "consisting," and "consisting essentially of" aspects and embodiments.

In some embodiments, reference to "about" a value or parameter herein includes (and describes) variations that are directed to that value or parameter per se. For example, description referring to "about X" includes description of "X".

"Particle" as used herein refers to any non-tissue derived composition of matter. It may be a sphere or sphere-like entity, bead, or liposome. The term "particle", the term "immune modifying particle", the term "carrier particle", and the term "bead" may be used interchangeably depending on the context. Additionally, the term "particle" may be used to encompass beads and spheres.

"Negatively charged particle" as used herein refers to particles which have been modified to possess a net surface charge that is less than zero.

"Carboxylated particles" or "carboxylated beads" or "carboxylated spheres" includes any particle that has been modified to contain a carboxyl group on its surface. In some embodiments the addition of the carboxyl group enhances phagocyte/monocyte uptake of the particles from circulation, for instance through the interaction with scavenger receptors such as MARCO. Carboxylation of the particles can be achieved using any compound which adds carboxyl groups, including, but not limited to, poly(ethylene-maleic anhydride) (PEMA).

"Carrier particle" as used herein refers to a particle that is covalently coupled to an antigen before forming a tolerizing immune modified particle (TIMP). Also, "carrier particle" or "carrier polymer" as used herein refers to a polymer that can be covalently attached to an antigen to form a tolerizing immune modified particle (TIMP). The particle may be a polymer which can be, but is not limited to, polystyrene, carboxylated polystyrene, diamond, PLURONIC® stabilized polypropylene sulfide or poly(lactic-co-glycolic acid).

"Unconjugated carrier polymer" or "unconjugated carrier particle" refers to a carrier polymer or carrier particle that does not comprise an antigen covalently bound thereto.

"Loading" as used herein refers to the amount of antigen per amount of carrier polymer. Loading can be expressed as micrograms (μg) of antigen per milligram (mg) of carrier polymer.

"Antigenic moiety" as used herein refers to any moiety, for example, a peptide that is recognized by the host's immune system. Examples of antigenic moieties include, but are not limited to, autoantigens, enzymes, and/or bacterial or viral proteins, peptides, drugs or components. Without being bound by theory, while the carboxylated beads themselves may be recognized by the immune system, the carboxylated beads with nothing more attached thereto are not considered an "antigenic moiety" for the purposes of the invention.

"Naked beads" or "naked particles" or "naked spheres" as used herein refers to beads, particles or spheres that have not been carboxylated.

"Pro-inflammatory mediators" or "pro-inflammatory polypeptides" as used herein refers to polypeptides or fragments thereof which induce, maintain, or prolong inflammation in a subject. Examples of pro-inflammatory mediators include, but are not limited to, cytokines and chemokines.

As used herein, the term "Inflammatory monocyte" refers to any myeloid cell expressing any combination of CD14/CD26 and CCR2.

As used herein, the term "inhibitory neutrophil" refers to neutrophils, and/or monocyte derived suppressor cells.

As used herein, the term "Th cell" or "helper T cell" refers to CD4+ cells. CD4+ T cells assist other white blood cells with immunologic processes, including maturation of B cells into plasma cells and memory B cells, and activation of cytotoxic T cells and macrophages. T cells become activated when they are presented with peptide antigens by MHC class II molecules, which are expressed on the surface of antigen-presenting cells (APCs).

As used herein, the term "Th1 cell" refers to a subset of Th cells which produce proinflammatory mediators. Th1 cells secrete cytokines to facilitate immune response and play a role in host defense against pathogens in part by mediating the recruitment of neutrophils and macrophages to infected tissues. Th1 cells secrete cytokines including IFN-gamma, IL2, IL-10, and TNF alpha/beta to coordinate defense against intracellular pathogens such as viruses and some bacteria.

As used herein, the term "Th2 cell" refers to a subset of Th cells that mediate the activation and maintenance of the antibody-mediated immune response against extracellular parasites, bacteria, allergens, and toxins. Th2 cells mediate these functions by producing various cytokines such as IL-4, IL-5, IL-6, IL-9, IL-13, and IL-17E (IL-25) that are responsible for antibody production, eosinophil activation, and inhibition of several macrophage functions, thus providing phagocyte-independent protective responses.

As used herein, the term "Th17 cell" refers to a subset of Th cells. Th17 cells secrete cytokines to facilitate immune response and play a role in host defense against pathogens by mediating the recruitment of neutrophils and macrophages to infected tissues. TH17 cells secrete cytokines such as IL17, IL21, IL22, IL24, IL26 and TNF alpha to coordinate defense against extracellular pathogens including fungi and bacteria.

"Coupled", "linked" or "crosslinked" as used herein with reference to an antigen refers to an antigen covalently bound or covalently attached to a carrier particle and encapsulated within the particle.

The term "IMP" as used herein refers to immune-modifying particles which are not coupled to an antigen. The term "TIMP" as used herein refers to tolerizing immune modifying particles which are coupled to an antigen. In certain embodiments, the term "IMP" as used herein refers to immune-modifying particles which do not comprise an antigen. The term "TIMP" as used herein refers to tolerizing immune modifying particles which comprise an antigen.

The term "bioactive agents" refers to agents other than those used to construct the particle (i.e. polymers, linkers) and the antigens contained therein. Examples of bioactive agents include drugs, immunomodulators and cytokines.

The particle may have any particle shape or conformation. However, in some embodiments it is preferred to use particles that are less likely to clump in vivo. Examples of particles within these embodiments are those that have a spherical shape.

One aspect of the invention relates to a composition which comprises an immune modified particle with a negative zeta potential coupled to one or more antigens, wherein the one or more antigens is encapsulated within the particle.

Yet another aspect of the invention relates to a process for the preparation of a tolerizing immune modified particle (TIMP) with a negative zeta potential, said process comprising: a) covalently linking one or more carrier polymers with one or more antigens to form carrier polymer-antigen conjugates; and b) combining carrier polymer-antigen conjugates with unconjugated carrier polymer at predetermined mixing ratios in a solution under conditions effective to form the TIMP, wherein a TIMP with a negative zeta potential is formed. In some embodiments of this invention, the carrier polymer is formed via copolymerization. The particle microstructure may depend on the method of co-polymerization.

In some embodiments, the present disclosure provides a process for the preparation of a tolerizing immune modified particle (TIMP) having a negative zeta potential, said process comprising: a) covalently linking one or more carrier polymers with one or more antigens to form carrier polymer-antigen conjugates; and b) contacting the carrier polymer-antigen conjugates with a solution under conditions effective to form the TIMP, wherein the TIMP having a negative zeta potential is formed, and wherein the one or more antigens is encapsulated in the TIMP. In some embodiments, the contacting the carrier polymer-antigen conjugates with a solution occurs in the presence of an unconjugated carrier polymer at predetermined mixing ratios.

In some embodiments, an antigenic peptide molecule is coupled to the carrier polymer (e.g. PLG) by a conjugate molecule and/or linker group. In some embodiments, coupling of the antigenic peptide and/or apoptotic signalling molecule to the carrier polymer (e.g., PLG) comprises one or more covalent interactions. In some embodiments, the antigenic peptide is encapsulated within the carrier particle with a negative zeta potential.

In one embodiment, the solution contacting the carrier polymer-antigen conjugates and unconjugated carrier polymer may have a basic pH. Suitable basic pH for the basic solution include 7.1, 7.5, 8.0, 8.5, 9.5, 10.0 10.5, 11.0, 11.5, 12.0, 12.5, 13.0, and 13.5. The solution may also be made of any suitable base and its conjugate. In some embodiments of the invention, the solution may include, without limitation, sodium bicarbonate, potassium bicarbonate, lithium bicarbonate, potassium dihydrogen phosphate, sodium dihydrogen phosphate, or lithium dihydrogen phosphate and conjugates thereof.

In one embodiment of the invention, the tolerizing immune modified particles contain co-polymers. These co-polymers may have varying molar ratio. Suitable co-polymer ratio of present tolerizing immune modified particles may be 25:75, 30:70, 35:65, 40:60, 45:55, 50:50, 55:45, 60:40, 65:35, 70:30, 75:25, 80:20, 81:19, 82:18, 83:17, 84:16, 85:15, 86:14, 87:13, 88:12, 89:11, 90:10, 91:9, 92:8, 93:7, 94:6, 95:5, 96:4, 97:3, 98:2, 99:1, or 100:0. In another embodiment, the co-polymer may be periodical, statistical, linear, branched (including star, brush, or comb co-polymers) co-polymers. In some embodiments, the copolymers ratio may be, but not limited to, polystyrene:poly(vinyl carboxylate)/80:20, polystyrene:poly(vinyl carboxylate)/90:10, poly(vinyl carboxylate):polystyrene/80:20, poly(vinyl carboxylate):polystyrene/90:10, polylactic acid:polyglycolic acid/50:50, polylactic acid:polyglycolic acid/80:20, or polylactic acid:polyglycolic acid/90:10.

In one embodiment, the particles of the invention are made by adding a composition comprising the carrier particle to a solution of an unconjugated carrier polymer. In some embodiments, the carrier particle is contacted with a solution in the presence of an unconjugated carrier polymer at predetermined mixing ratios. In some embodiments, the unconjugated carrier polymer is PLG (poly(lactide-co-glycolic acid)).

In one embodiment, the particles of the invention are made by adding a composition comprising the polymer to a solution of a biocompatible polymer. Examples of biocompatible polymers include Poly(ethylene-maleic anhydride)

(PEMA) and citric acid based polymer scaffolds. Further examples of biocompatible polymers include poly(alpha-esters), polyurethanes, poly(ester amide), poly(ortho esters), polyanhydrides, poly(anhydride-co-imide), cross-linked polyanhydrides, poly(propylene fumarate), pseudo poly (amino acid), poly(alkyl cyanoacrylates), polyphosphazenes, polyphosphoester, poly(amino acids), polysaccharides, poly(ethylene glycol). (Nair et al. Progress in Polymer Science, 32 (2007) 762-798, which is incorporated herein by reference) A solution of biocompatible polymer can include same or different polymers and mixed in different ratios to provide different effects.

In one embodiment, the particles of 0.6% 0.8%, 0.9%, 1%, 1.5%, 2.5%, 3%, 3.5%, 4%, 4.5%, 5%, 6%, 6.5%, 7%, 7.5%, 8%, 8.5%, 9%, 9.5% or 10%. In embodiment, the percentage of PEMA in the solution is about 0.5%. In another embodiment, the percentage of PEMA in the solution is about 1.0%. Other compounds that may be used include, but are not limited to, Poly(ethylene-alt-maleic anhydride), Poly(isobutylene-co-maleic acid), Poly(methyl vinyl ether-alt-maleic acid), Poly(methyl vinyl ether-alt-maleic acid monoethyl ester), Poly(methyl vinyl ether-alt-maleic anhydride), Poly(methyl vinyl ether-alt-maleic anhydride) cross-linked with 1,9-decadiene powder, and/or Poly (styrene-alt-maleic acid) sodium salt.

In one embodiment, the particle is a liposome. In a further embodiment, the particle is a liposome composed of the following lipids at the following molar ratios—30:30:40 phosphatidylcholine:phosphatidylglycerol:cholesterol. In yet a further embodiment, the particle is encapsulated within a liposome.

It is not necessary that each particle be uniform in size, although the particles must generally be of a size sufficient to be sequestered in the spleen or liver and trigger phagocytosis or uptake through receptor or non-receptor mediated mechanism by an antigen presenting cell, including endothelial cell or other MPS cell. Preferably, the particles are microscopic or nanoscopic in size, in order to enhance solubility, avoid possible complications caused by aggregation in vivo and to facilitate pinocytosis. Particle size can be a factor for uptake from the interstitial space into areas of lymphocyte maturation. A particle having a diameter of from about 0.1 □m to about 10 □m is capable of triggering phagocytosis. Thus in one embodiment, the particle has a diameter within these limits. In another embodiment, the particle has an average diameter of about 0.3 µm to about 5 µm. In still another embodiment, the particle has an average diameter of about 0.5 µm to about 3 µm. In another embodiment, the particle has an average diameter of about 0.2 µm to about 2 µm. In a further embodiment the particle has an average size of about 0.1 µm, or about 0.2 µm or about 0.3 µm or about 0.4 µm or about 0.5 µm or about 1.0 µm or about 1.5 µm or about 2.0 µm or about 2.5 µm or about 3.0 µm or about 3.5 µm or about 4.0 µm or about 4.5 µm or about 5.0 µm. In a particular embodiment the particle has an average size of about 0.5 µm. In some embodiments, the overall weights of the particles are less than about 10,000 kDa, less than about 5,000 kDa, or less than about 1,000 kDa, 500 kDa, 400 kDa, 300 kDa, 200 kDa, 100 kDa, 50 kDa, 20 kDa, 10 kDa. The particles in a composition need not be of uniform diameter. By way of example, a pharmaceutical formulation may contain a plurality of particles, some of which are about 0.5 □m, while others are about 1.0 □m. Any mixture of particle sizes within these given ranges will be useful.

The particles of the current invention can possess a particular zeta potential. In certain embodiments, the zeta potential is negative. In one embodiment, the zeta potential is less than about −100 mV. In one embodiment, the zeta potential is less than about −50 mV. In certain embodiments, the particles possess a zeta potential between −100 mV and 0 mV. In a further embodiment, the particles possess a zeta potential between −75 mV and 0 mV. In a further embodiment, the particles possess a zeta potential between −60 mV and 0 mV. In a further embodiment, the particles possess a zeta potential between −50 mV and 0 mV. In still a further embodiment, the particles possess a zeta potential between −40 mV and 0 mV. In a further embodiment, the particles possess a zeta potential between −30 mV and 0 mV. In a further embodiment, the particles possess a zeta potential between −20 mV and +0 mV. In a further embodiment, the particles possess a zeta potential between −10 mV and −0 mV. In a further embodiment, the particles possess a zeta potential between −100 mV and −50 mV. In another particular embodiment, the particles possess a zeta potential between −75 mV and −50 mV. In a particular embodiment, the particles possess a zeta potential between −50 mV and −40 mV.

In some embodiments, the charge of a carrier (e.g., positive, negative, neutral) is selected to impart application-specific benefits (e.g., physiological compatibility, beneficial surface-peptide interactions, etc.). In some embodiments, a carrier has a net neutral or negative charge (e.g., to reduce non-specific binding to cell surfaces which, in general, bear a net negative charge). In certain embodiments carrier polymers are capable of being covalently conjugated, either directly or indirectly, to an antigen to which tolerance is desired (also referred to herein as an antigen-specific peptide, antigenic peptide, autoantigen, inducing antigen or tolerizing antigen). In some embodiments, carrier polymer-antigen conjugates are mixed with unconjugated carrier polymer at predetermined mixing ratios. In some embodiments, the predetermined mixing ratios can be 5:95, 10:90, 15:85, 20:80, 25:75, 30:70, 35:65, 40:60, 45:55, 50:50, 55:45, 60:40, 65:35, 70:30, 75:25, 80:20, 85:15, 90:10, or 95:5. In some embodiments, the predetermined mixing ratio is 50:50. In some instances, a carrier has multiple binding sites (e.g., 2, 3, 4, 5, 6, 7, 8, 9, 10 . . . 20 . . . 50 . . . 100, or more) in order to have multiple copies of an antigen-specific peptide, or multiple different peptides encapsulated within the carrier particle (e.g., to increase the likelihood of a tolerance response). In some embodiments, a carrier encapsulates a single type of antigenic peptide. In some embodiments, a carrier encapsulates multiple different antigenic peptides.

In some embodiments, the loading of antigen is about 0.10, 0.20, 0.30, 0.40, 0.50, 0.60, 0.70, 0.80, 0.90, 1, 2, 3, 4, 5, 6, 7, 8, 9, 10, 11, 12, 13, 14, 15, 16, 17, 18, 19, 20 µg antigen/mg carrier polymer and all values in between. In some embodiments, the loading of antigen is about 0.10 to about 0.50 µg antigen/mg carrier polymer. In some embodiments, the loading of antigen is about 0.50 to about 2 µg antigen/mg carrier polymer. In some embodiments, the loading of antigen is about 2 to about 4 µg antigen/mg carrier polymer. In some embodiments, the loading of antigen is about 4 to about 8 µg antigen/mg carrier polymer. In some embodiments, the loading of antigen is about 8 to about 16 µg antigen/mg carrier polymer. In some embodiments, the loading of antigen is about 16 to about 20 µg antigen/mg carrier polymer. In some embodiments, the loading of antigen is about 20 to about 30 µg antigen/mg carrier polymer. In some embodiments, the loading of antigen is about 30 to about 40 µg antigen/mg carrier polymer. In some embodiments, the loading of antigen is about 40 to about 50 µg antigen/mg carrier polymer. In some embodiments, the loading of antigen is about 50 to about 60 µg antigen/mg carrier polymer. In some embodiments, the loading of antigen is about 60 to about 70 µg antigen/mg carrier polymer. In some embodiments, the loading of antigen is about 70 µg antigen or more/mg carrier polymer.

The size and charge of the particles are critical for tolerance induction. While the particles will differ in size and charge based on the antigen encapsulated within them (See Table 1 and Table 5 for examples of specific particles), in general, particles of the current invention are effective at inducing tolerance when they are between about 100 nanometers and about 1500 nanometers and have a charge of 0 to about −100 mV and are most effective at inducing tolerance when they are 400-800 microns and have a charge of between about −25 mV and −70 mV. As used herein, the term "post-synthesis size" and "post synthesis charge" refer to the size and charge of the particle prior to lyophilization. The term "post lyophilization size" and "post lyophilization charge" refer to the size and charge of the particle after lyophilization. Table 1 shows the sizes and zeta potentials of representative nanoparticle formulations. Particles with various sizes were prepared by the double emulsion and nanoprecipitation methods. Loading (pg antigen (Ag)/mg PLG) was precisely controlled by combining PLG-Ag conjugates with unconjugated PLG at predetermined mixing ratios. Tables 1 and 5 show sizes and zeta potentials of representative nanoparticle formulations.

TABLE 1

Sizes and zeta potentials of representative nanoparticle formulations

| Type | Particle | Loading (□g/mg) | Size (nm ± S.D.) | Zeta (mV ± S.D.) |
|---|---|---|---|---|
| Double Emulsion | PLG | 0 | 521.5 ± 23. | −56.0 ± 0.67 |
| | PLG-Cy5.5 | 0 | 454.8 ± 26 | −39.7 ± 0.47 |
| | PLG-OVA | 0.1 | 406.0 ± 6.4 | −52.2 ± 1.1 |
| | PLG-OVA | 0.5 | 456.5 ± 9.3 | −34.9 ± 2.0 |
| | PLG-OVA | 2 | 421.2 ± 1.5 | −58.1 ± 2.9 |
| | PLG-OVA | 8 | 443.7 ± 7.8 | −52.6 ± 1.2 |
| Nano-precipitation | PLG | 0 | 72.2 ± 1.9 | −33.5 ± 1.1 |
| | PLG-Cy5.5 | 0 | 79.04 ± 0.78 | −31.3 ± 0.55 |
| | PLG-OVA | 0.1 | 74.8 ± 0.25 | −34.5 ± 0.25 |
| | PLG-OVA | 0.5 | 85.6 ± 1.9 | −31.5 ± 1.2 |

In some embodiments, the particle is non-metallic. In these embodiments the particle may be formed from a polymer. In a preferred embodiment, the particle is biodegradable in an individual. In this embodiment, the particles can be provided in an individual across multiple doses without there being an accumulation of particles in the individual. Examples of suitable particles include polystyrene particles, PLGA particles, PLURONIC® stabilized polypropylene sulfide particles, and diamond particles. In some embodiments, suitable particles include particles prepared from general classes of polymers such as poly(alpha-esters), polyurethanes, poly(ester amide), poly(ortho esters), polyanhydrides, poly(anhydride-co-imide), cross-linked polyanhydrides, poly(propylene fumarate), pseudo poly (amino acid), poly(alkyl cyanoacrylates), polyphosphazenes, polyphosphoester, poly(amino acids), and polysaccharides.

Preferably the particle surface is composed of a material that minimizes non-specific or unwanted biological interactions. Interactions between the particle surface and the interstitium may be a factor that plays a role in lymphatic uptake. The particle surface may be coated with a material to prevent or decrease non-specific interactions. Steric stabilization by coating particles with hydrophilic layers such as poly(ethylene glycol) (PEG) and its copolymers such as PLURONIC® (including copolymers of poly(ethylene glycol)-bl-poly(propylene glycol)-bl-poly(ethylene glycol)) may reduce the non-specific interactions with proteins of the interstitium as demonstrated by improved lymphatic uptake following subcutaneous injections. All of these facts point to the significance of the physical properties of the particles in terms of lymphatic uptake. Biodegradable polymers may be used to make all or some of the polymers and/or particles and/or layers. Biodegradable polymers may undergo degradation, for example, by a result of functional groups reacting with the water in the solution. The term "degradation" as used herein refers to becoming soluble, either by reduction of molecular weight or by conversion of hydrophobic groups to hydrophilic groups. Polymers with ester groups are generally subject to spontaneous hydrolysis, e.g., polylactides and polyglycolides.

Particles of the present invention may also contain additional components. For example, carriers may have imaging agents incorporated or conjugated to the carrier. An example of a carrier nanosphere having an imaging agent that is currently commercially available is the Kodak X-sight nanospheres. Inorganic quantum-confined luminescent nanocrystals, known as quantum dots (QDs), have emerged as ideal donors in FRET applications: their high quantum yield and tunable size-dependent Stokes Shifts permit different sizes to emit from blue to infrared when excited at a single ultraviolet wavelength. (Bruchez, et al., Science, 1998, 281, 2013; Niemeyer, C. M Angew. Chem. Int. Ed. 2003, 42, 5796; Waggoner, A. Methods Enzymol. 1995, 246, 362; Brus, L. E. J. Chem. Phys. 1993, 79, 5566). Quantum dots, such as hybrid organic/inorganic quantum dots based on a class of polymers known as dendrimers, may used in biological labeling, imaging, and optical biosensing systems. (Lemon, et al., J. Am. Chem. Soc. 2000, 122, 12886). Unlike the traditional synthesis of inorganic quantum dots, the synthesis of these hybrid quantum dot nanoparticles does not require high temperatures or highly toxic, unstable reagents. (Etienne, et al., Appl. Phys. Lett. 87, 181913, 2005).

Particles of the present invention may be covalently linked to an imaging agent such as a cyanine fluorescent dye. In some embodiments, the cyanines comprise open chain cyanines, hemicyanines and/or closed chain cyanines. In some embodiments, the cyanine fluorescent dye comprises Cy2, Cy3, Cy3B, Cy3.5, Cy5, Cy5.5 and Cy7. In some embodiments, the particles are covalently linked to Cy5.5 for in vivo imaging.

Particles can be formed from a wide range of materials. The particle is preferably composed of a material suitable for biological use. For example, particles may be composed of glass, silica, polyesters of hydroxy carboxylic acids, polyanhydrides of dicarboxylic acids, or copolymers of hydroxy carboxylic acids and dicarboxylic acids. More generally, the carrier particles may be composed of polyesters of straight chain or branched, substituted or unsubstituted, saturated or unsaturated, linear or cross-linked, alkanyl, haloalkyl, thioalkyl, aminoalkyl, aryl, aralkyl, alkenyl, aralkenyl, heteroaryl, or alkoxy hydroxy acids, or polyanhydrides of straight chain or branched, substituted or unsubstituted, saturated or unsaturated, linear or cross-linked, alkanyl, haloalkyl, thioalkyl, aminoalkyl, aryl, aralkyl, alkenyl, aralkenyl, heteroaryl, or alkoxy dicarboxylic acids. Additionally, carrier particles can be quantum dots, or composed of quantum dots, such as quantum dot polystyrene particles (Joumaa et al. (2006) Langmuir 22: 1810-6).

Carrier particles including mixtures of ester and anhydride bonds (e.g., copolymers of glycolic and sebacic acid) may also be employed. For example, carrier particles may comprise materials including polyglycolic acid polymers (PGA), polylactic acid polymers (PLA), polysebacic acid polymers (PSA), poly(lactic-co-glycolic) acid copolymers (PLGA or PLG; the terms are interchangeable), [rho]oly(lactic-co-sebacic) acid copolymers (PLSA), poly(glycolic-co-sebacic) acid copolymers (PGSA), polypropylene sulfide polymers, poly(caprolactone), chitosan, etc. Other biocompatible, biodegradable polymers useful in the present invention include polymers or copolymers of caprolactones, carbonates, amides, amino acids, orthoesters, acetals, cyanoacrylates and degradable urethanes, as well as copolymers of these with straight chain or branched, substituted or unsubstituted, alkanyl, haloalkyl, thioalkyl, aminoalkyl, alkenyl, or aromatic hydroxy- or di-carboxylic acids. In addition, the biologically important amino acids with reactive side chain groups, such as lysine, arginine, aspartic acid, glutamic acid, serine, threonine, tyrosine and cysteine, or their enantiomers, may be included in copolymers with any of the aforementioned materials to provide reactive groups for conjugating to antigen peptides and proteins or conjugating moieties. Biodegradable materials suitable for the present invention include diamond, PLA, PGA, polypropylene sulfide, and PLGA polymers. Biocompatible but non-biodegradable materials may also be used in the carrier particles of the invention. For example, non-biodegradable polymers of acrylates, ethylene-vinyl acetates, acyl substituted cellulose acetates, non-degradable urethanes, styrenes, vinyl chlorides, vinyl fluorides, vinyl imidazoles, chlorosulphonated olefins, ethylene oxide, vinyl alcohols, TEFLON® (DuPont, Wilmington, Del.), and nylons may be employed.

Preparation of Compositions

The particles of the instant invention can be manufactured by any means commonly known in the art. Exemplary methods of manufacturing particles include, but are not limited to, microemulsion polymerization, interfacial polymerization, precipitation polymerization, emulsion evaporation, emulsion diffusion, solvent displacement, and salting out (Astete and Sabliov, J. Biomater. Sci. Polymer Edn., 17:247-289(2006)). Manipulation of the manufacturing process for PLGA particles can control particle properties (e.g. size, size distribution, zeta potential, morphology, hydrophobicity/hydrophilicity, polypeptide entrapment, etc). The size of the particle is influenced by a number of factors including, but not limited to, the concentration of PLGA, the solvent used in the manufacture of the particle, the nature of the organic phase, the surfactants used in manufacturing, the viscosity of the continuous and discontinuous phase, the nature of the solvent used, the temperature of the water used, sonication, evaporation rate, additives, shear stress, sterilization, and the nature of any encapsulated antigen or polypeptide.

Particle size is affected by the polymer concentration; higher particles are formed from higher polymer concentrations. For example, an increase in PLGA concentration from 1% to 4% (w/v) can increase mean particle size from about 205 nm to about 290 nm when the solvent propylene carbonate is used. Alternatively, in ethyl acetate and 5% Pluronic F-127, an increase in PLGA concentration from 1% to 5% (w/v) increases the mean particle size from 120 nm to 230 nm.

The viscosity of the continuous and discontinuous phase is also an important parameter that affects the diffusion process, a key step in forming smaller particles. The size of the particles increases with an increase in viscosity of the dispersed phase, whereas the size of the particles decreases with a more viscous continuous phase. In general, the lower the phase ratio of organic to aqueous solvent, the smaller the particle size.

Homogenizer speed and agitation also affect particle size; in general, higher speeds and agitation cause a decrease in particle size, although there is a point where further increases in speed and agitation no longer decrease particle size. There is a favorable impact in the size reduction when the emulsion is homogenized with a high pressure homogenizer compared with just high stirring. For example, at a phase ratio of 20% in 5% PVA, the mean particle size with stirring is 288 nm and the mean particle size with homogenization (high pressure of 300 bars) is 231 nm.

An important size reduction of the particles can be achieved by varying the temperature of the water added to improve the diffusion of the solvent. The mean particle size decreases with an increase in water temperature.

The nature of the polypeptide encapsulated in the particle also affects particle size. In general, encapsulation of hydrophobic polypeptides leads to the formation of smaller particles compared with the encapsulation of more hydrophilic polypeptides. In the double emulsion process, the entrapment of more hydrophilic polypeptides is improved by using high molecular mass PLGA and a high molecular mass of the first surfactant which causes a higher inner phase viscosity. The interaction between the solvent, polymer, and polypeptide affects the efficiency of incorporating the polypeptide into the particle.

The PLGA molecular mass impacts the final mean particle size. In general, the higher the molecular mass, the higher the mean particle size. For example, as the composition and molecular mass of PLGA varies (e.g. 12 to 48 kDa for 50:50 PLGA; 12 to 98 kDa for 75:25 PLGA) the mean particle size varies (about 102 nm-154 nm; about 132 nm to 152 nm respectively). Even when particles are the same molecular mass, their composition can affect average particle size; for example, particles with a 50:50 ratio generally form particles smaller than those with a 75:25 ratio. The end groups on the polymer also affect particle size. For example, particles prepared with ester end-groups form particles with an average size of 740 nm (PI=0.394) compared with the mean size for the acid PLGA end-group is 240 nm (PI=0.225).

The solvent used can also affect particle size; solvents that reduce the surface tension of the solution also reduce particle size.

The organic solvent is removed by evaporation in a vacuum to avoid polymer and polypeptide damage and to promote final particle size reduction. Evaporation of the organic solvent under vacuum is more efficient in forming smaller particles. For example, evaporation in vacuum produces a mean particle size around 30% smaller than the mean particle size produced under a normal rate of evaporation.

The amplitude of the sonication wavelength also affects the particle characteristics. The amplitude of the wavelength should be over 20% with 600 to 800 s of sonication to form stable miniemulsions with no more droplet size changes. However, the main draw-back of sonication is the lack of monodispersity of the emulsion formed.

Organic phases that may be used in the production of the particles of the invention include, but are not limited to, methylene chloride, ethyl acetate, methyl ethyl ketone, propylene carbonate, and benzyl alcohol. The continuous phases that may be used include, but are not limited to, the surfactant poloxamer 188.

A variety of surfactants can be used in the manufacturing of the particles of the invention. The surfactant can be anionic, cationic, or nonionic. Surfactants in the poloxamer and poloaxamines family are commonly used in particle synthesis. Surfactants that may be used, include, but are not limited to PEG, Tween-80, gelatin, dextran, pluronic L-63, PVA, methylcellulose, lecithin, DMAB, PEMA, sodium deoxycholate, poly(acrylic acid), hyaluronic acid, and other negatively-charged naturally occurring or synthetic small molecules or polymers. Additionally, biodegradable and biocompatible surfactants including, but not limited to, vitamin E TPGS (D-α-tocopheryl polyethylene glycol 1000 succinate). In certain embodiments, two surfactants are needed (e.g. in the double emulsion evaporation method). These two surfactants can include a hydrophobic surfactant for the first emulsion, and a hydrophobic surfactant for the second emulsion.

Another manufacturing technique includes nanoprecipitation. For example, a polymer is soluble in an organic solvent, yet the organic solvent is miscible with the aqueous phase. Upon mixing the organic (polymer-containing solution) with the aqueous phase, the polymer can precipitate and form particles since the aqueous phase is a non-solvent for the polymer.

Solvents that may be used in the production of the particles of the invention include, but are not limited to, ethyl acetate, acetone, Tetrahydrofuran (THF), chloroform, and members of the chlorinate family, methylene chloride. The choice of organic solvents require two selection criteria: the polymer must be soluble in this solvent, and the solvent must be completely immiscible with the aqueous phase.

Salts that may be used in the production of the particles of the invention include, but are not limited to magnesium chloride hexahydrate, magnesium acetate tetrahydrate.

Common salting-out agents include, but are not limited to, electrolytes (e.g. sodium chloride, magnesium acetate, magnesium chloride), or non-electrolytes (e.g. sucrose).

The stability and size of the particles of the invention may be improved by the addition of compounds including, but not limited to, fatty acids or short chains of carbons. The addition of the longer carbon chain of lauric acid is associated with the improvement of particle characteristics. Furthermore, the addition of hydrophobic additives can improve the particle size, incorporation of the polypeptide into the particle, and release profile. Preparations of particles can be stabilized by lyophilization. The addition of a cryoprotectant such as trehalose can decrease aggregation of the particles upon lyophilization.

Suitable beads which are currently available commercially include polystyrene beads such as FluoSpheres (Molecular Probes, Eugene, Oreg.).

In some embodiments, the present invention provides systems comprising: (a) a delivery scaffold configured for the delivery of chemical and/or biological agents to a subject; and (b) antigen-coupled poly(lactide-co-glycolide) particles for induction of antigen-specific tolerance. In some embodiments, at least a portion of said delivery scaffold is microporous. In some embodiments, the antigen-coupled poly(lactide-co-glycolide) particles are encapsulated within said scaffold. In some embodiments, the chemical and/or biological agents are selected from the group consisting of: protein, peptide, small molecules, nucleic acids, cells, and particles. In some embodiments, chemical and/or biological agents comprise cell, and said cells comprise pancreatic islet cells.

Physical properties are also related to a nanoparticle's usefulness after uptake and retention in areas having immature lymphocytes. These include mechanical properties such as rigidity or rubberiness. Some embodiments are based on a rubbery core, e.g., a poly(propylene sulfide) (PPS) core with an overlayer, e.g., a hydrophilic overlayer, as in PEG, as in the PPS-PEG system recently developed and characterized for systemic (but not targeted or immune) delivery. The rubbery core is in contrast to a substantially rigid core as in a polystyrene or metal nanoparticle system. The term rubbery refers to certain resilient materials besides natural or synthetic rubbers, with rubbery being a term familiar to those in the polymer arts. For example, cross-linked PPS can be used to form a hydrophobic rubbery core. PPS is a polymer that degrades under oxidative conditions to polysulphoxide and finally polysulphone, transitioning from a hydrophobic rubber to a hydrophilic, water-soluble polymer. Other sulphide polymers may be adapted for use, with the term sulphide polymer referring to a polymer with a sulphur in the backbone of the mer. Other rubbery polymers that may be used are polyesters with glass transition temperature under hydrated conditions that is less than about 37° C. A hydrophobic core can be advantageously used with a hydrophilic overlayer since the core and overlayer will tend not to mingle, so that the overlayer tends to sterically expand away from the core. A core refers to a particle that has a layer on it. A layer refers to a material covering at least a portion of the core. A layer may be adsorbed or covalently bound. A particle or core may be solid or hollow. Rubbery hydrophobic cores are advantageous over rigid hydrophobic cores, such as crystalline or glassy (as in the case of polystyrene) cores, in that higher loadings of hydrophobic drugs can be carried by the particles with the rubbery hydrophobic cores.

Another physical property is the surface's hydrophilicity. A hydrophilic material may have a solubility in water of at least 1 gram per liter when it is uncrosslinked. Steric stabilization of particles with hydrophilic polymers can improve uptake from the interstitium by reducing non-specific interactions; however, the particles' increased stealth nature can also reduce internalization by phagocytic cells in areas having immature lymphocytes. The challenge of balancing these competing features has been met, however, and this application documents the creation of nanoparticles for effective lymphatic delivery to DCs and other APCs in lymph nodes. Some embodiments include a hydrophilic component, e.g., a layer of hydrophilic material. Examples of suitable hydrophilic materials are one or more of polyalkylene oxides, polyethylene oxides, polysaccharides, polyacrylic acids, and polyethers. The molecular weight of polymers in a layer can be adjusted to provide a useful degree of steric hindrance in vivo, e.g., from about 1,000 to about 100,000 or even more; artisans will immediately appreciate that all the ranges and values within the explicitly stated ranges are contemplated, e.g., between 10,000 and 50,000.

The nanoparticles may incorporate functional groups for further reaction. Functional groups for further reaction include electrophiles or nucleophiles; these are convenient for reacting with other molecules. Examples of nucleophiles are primary amines, thiols, and hydroxyls. Examples of electrophiles are succinimidyl esters, aldehydes, isocyanates, and maleimides.

A great variety of means, well known in the art, may be used to conjugate antigenic peptides and proteins to carrier polymers. These methods include any standard chemistries which do not destroy or severely limit the biological activity of the antigen peptides and proteins, and which allow for a sufficient number of antigen peptides and proteins to be conjugated to the carrier polymer in an orientation which allows for interaction of the antigen peptide or protein with a cognate T cell receptor. Generally, methods are preferred which conjugate the C-terminal regions of an antigen peptide or protein, or the C-terminal regions of an antigen peptide or protein fusion protein, to the earner. The exact chemistries will, of course, depend upon the nature of the earner material, the presence or absence of C-terminal fusions to the antigen peptide or protein, and/or the presence or absence of conjugating moieties.

Functional groups can be located on the carrier polymer as needed for availability. One location can be as side groups or termini on the core polymer or polymers that are layers on a core or polymers otherwise tethered to the particle. For instance, examples are included herein that describe PEG stabilizing the nanoparticles that can be readily functionalized for specific cell targeting or protein and peptide drug delivery.

Conjugation Procedure

The present disclosure provides conjugates of carrier particles (e.g., carrier polymers). The polymer is typically a chemical species containing a plurality of repeating units that are bonded to each other. A polymer may contain more than one different repeating unit. The repeating unit typically derives from polymerization of a monomer. A copolymer specifically refers to a polymer containing two or more structurally different repeating units. The different repeating units of a polymer may be randomly ordered in the polymer chain or the same repeating units may be grouped into contiguous blocks in the polymer. When there are contiguous blocks of the two or more repeating units in a polymer, the polymer is a block copolymer. In certain embodiments, the polymer is a graft co-polymer. As used herein the term polymer refers to a chemical species containing more than about 10 repeating units.

Suitable carrier particle (e.g., carrier polymer) for conjugation comprises functional group for reaction. The carrier particle (e.g., carrier polymer) described herein can be chemically modified by reactions to introduce a desired terminal functional group. Terminal functional groups include among others, carboxyl, hydroxyl, thiol, amine, azide, alkyne, alkene, ketone, phenol, halide, imidazole, guanidinium, carboxylate, or phosphate groups. These functional groups can be introduced at the terminus of the carrier particle (e.g., carrier polymer) herein employing well known chemical methods.

The functional groups can be employed to further conjugate the carrier particle (e.g., carrier polymer) with other chemical species, such as other polymers, other oligomers, peptides, proteins, small molecules, carbohydrates, antibodies, nucleic acids, and/or aptamers.

In certain embodiments, the carrier particle (e.g., carrier polymer) comprises a carboxyl group, which can be conjugated to an amino-containing conjugate partner with use of carbodiimide crosslinking chemistry. Carbodiimide reagents are used as coupling reagents for reaction of carboxylic acids towards amide or ester formation. Examples of carbodiimide reagents include EDCI (1-ethyl-3-(3-dimethylaminopropyl)carbodiimide, or EDC, or ECDI), DCC (N,N'-dicyclohexylcarbodiimide), and DIC (N,N'-diisopropylcarbodiimide). In addition to the coupling reagent, activation reagents may be used to facilitate the reaction. Examples of activating reagents include hydroxysuccinimide. Reaction of carbodiimide-activated carboxylic acid on a carrier particle (e.g., carrier polymer) with an amino-containing conjugate partner can produce an amide bond connecting the carrier polymer and conjugate partner.

In certain embodiments, the carrier particle (e.g., carrier polymer) and the conjugate partner (e.g., antigen) are coupled with use of polyfunctional coupling reagents (e.g., bifunctional coupling reagents). The selection of the polyfunctional coupling reagent depends on the functional groups present on the carrier particle (e.g., carrier polymer) and the conjugate partner (e.g., antigen).

The groups of the polyfunctional coupling reagent can independently include a carboxyl-reactive group, carbonyl-reactive group, an amine-reactive group, a thiol-reactive group or a photo-reactive group, but are not the same (e.g., orthogonal). Examples of carboxyl-reactive groups include hydrazine derivatives and amines. Examples of carbonyl-reactive groups include aldehyde- and ketone-reactive groups like hydrazine derivatives and amines. Examples of amine-reactive groups include active esters such as NHS or sulfo-NHS, isothiocyanates, isocyanates, acyl azides, sulfonyl chlorides, aldehydes, glyoxals, epoxides, oxiranes, carbonates, aryl halides, imidoesters, anhydrides and the like. Examples of thiol-reactive groups include non-polymerizable Michael acceptors, haloacetyl groups (such as iodoacetyl), alkyl halides, maleimides, aziridines, acryloyl groups, vinyl sulfones, benzoquinones, aromatic groups that can undergo nucleophilic substitution such as fluorobenzene groups (such as tetra and pentafluorobenzene groups), and disulfide groups such as pyridyl disulfide groups and thiols activated with Ellman's reagent. Examples of photo-reactive groups include aryl azide and halogenated aryl azides. Additional examples of each of these types of groups will be apparent to those skilled in the art. Further examples and information regarding reaction conditions and methods for exchanging one type of reactive group for another are provided in Hermanson, "Bioconjugate Techniques," Academic Press, San Diego, 1996, which is incorporated by reference herein.

Alternate Conjugation Procedure

Conjugates such as ethylene carbodiimide (EDCI), hexamethylene diisocyanate, propyleneglycol di-glycidylether which contain 2 epoxy residues, and epichlorohydrin may be used for fixation of peptides or proteins to the carrier polymer. Without being bound by theory, EDCI is suspected of carrying out two major functions for induction of tolerance: (a) it chemically couples the protein/peptides to the carrier polymer via catalysis of peptide bond formation between free amino and free carboxyl groups; and (b) it induces the carrier to mimic apoptotic cell death such that they are picked up by host antigen presenting cells (which may include endothelial cells) in the spleen and induce tolerance. It is this presentation to host T-cells in a non-immunogenic fashion that leads to direct induction of anergy in autoreactive cells. In addition, EDCI serves as a potent stimulus for the induction of specific regulatory T cells.

In one series of embodiments, the antigen peptides and proteins are bound to the carrier polymer via a covalent chemical bond. For example, a reactive group or moiety near the C-terminus of the antigen (e.g., the C-terminal carboxyl group, or a hydroxyl, thiol, or amine group from an amino acid side chain) may be conjugated directly to a reactive group or moiety of the carrier polymer (e.g., a hydroxyl or carboxyl group of a PLA or PGA polymer, a terminal amine or carboxyl group of a dendrimer, or a hydroxyl, carboxyl or phosphate group of a phospholipid) by direct chemical reaction. Alternatively, there may be a conjugating moiety which covalently conjugates to both the antigen peptides and proteins and the carrier polymer, thereby linking them together.

Reactive carboxyl groups of a carrier polymer may be joined to free amines (e.g., from Lys residues) on the antigen peptide or protein, by reacting them with, for example, 1-ethyl-3-[3,9-dimethyl aminopropyl]carbodiimide hydrochloride (EDC) or N-hydroxysuccinimide ester (NETS). Similarly, the same chemistry may be used to conjugate free amines on the surface of a carrier polymer with free carboxyls (e.g., from the C-terminus, or from Asp or Glu residues) on the antigen peptide or protein. Alternatively, free amine groups on a carrier polymer may be covalently bound to antigen peptides and proteins, or antigen peptide or protein fusion proteins, using sulfo-SIAB chemistry, essentially as described by Arano et al. (1991) Chem. 2:71-6.

Conjugation of a nucleic acid moiety to a platform molecule can be effected in any number of ways, typically involving one or more crosslinking agents and functional groups on the nucleic acid moiety and platform molecule. Linking groups are added to platforms using standard synthetic chemistry techniques. Linking groups can be added to nucleic acid moieties using standard synthetic techniques. The practitioner has a number of choices for antigens used in the combinations of this invention. The inducing antigen present in the combination contributes to the specificity of the tolerogenic response that is induced. It may or may not be the same as the target antigen, which is the antigen present or to be placed in the subject being treated which is a target for the unwanted immunological response, and for which tolerance is desired.

Biological and Chemical Antigens

An inducing antigen of this invention may be a polypeptide, polynucleotide, carbohydrate, glycolipid, or other molecule isolated from a biological source, or it may be a chemically synthesized small molecule, polymer, or derivative of a biological material, providing it has the ability to induce tolerance according to this description when combined with the mucosal binding component.

In some embodiments, the present invention provides a carrier polymer covalently coupled to one or more peptides, polypeptides, and/or proteins. In some embodiments, a carrier (e.g., PLG carrier), such as those described herein, are effective to induce antigen-specific tolerance and/or prevent the onset of an immune related disease (such as EAE in a mouse model) and/or diminish the severity of a pre-existing immune related disease. In some embodiments, the compositions and methods of the present invention can cause T cells to undertake early events associated with T-cell activation, but do not allow T-cells to acquire effector function. For example, administration of compositions of the present invention can result in T-cells having a quasi-activated phenotype, such as CD69 and/or CD44 upregulation, but do not display effector function, such as indicated by a lack of IFN-γ or IL-17 synthesis. In some embodiments, administration of compositions of the present invention results in T-cells having a quasi-activated phenotype without having conversion of naive antigen-specific T-cells to a regulatory phenotype, such as those having $CD25^+/Foxp3^+$ phenotypes.

In some embodiments, a carrier comprises one or more biological or chemical agents adhered to, adsorbed on, encapsulated within, and/or contained throughout the carrier. In some embodiments, a chemical or biological agent is encapsulated in and/or contained throughout the particles. The present invention is not limited by the nature of the chemical or biological agents. Such agents include, but are not limited to, proteins, nucleic acid molecules, small molecule drugs, lipids, carbohydrates, cells, cell components, and the like. In some embodiments, two or more (e.g., 3, 4, 5, etc.) different chemical or biological agents are included on or within the carrier. In some embodiments, agents are configured for specific release rates. In some embodiments, multiple different agents are configured for different release rates. For example, a first agent may release over a period of hours while a second agent releases over a longer period of time (e.g., days, weeks, months, etc.). In some embodiments, the carrier or a portion thereof is configured for slow-release of biological or chemical agents. In some embodiments, the slow release provides release of biologically active amounts of the agent over a period of at least 30 days (e.g., 40 days, 50 days, 60 days, 70 days, 80 days, 90 days, 100 days, 180 days, etc.). In some embodiments, the carrier or a portion thereof is configured to be sufficiently porous to permit ingrowth of cells into the pores. The size of the pores may be selected for particular cell types of interest and/or for the amount of ingrowth desired. In some embodiments, the particles comprise the antigen of interest without other non-peptide active agents, such as drugs or immunomodulators. Furthermore, in some embodiments the particles of the invention do not contain immunostimulatory or immunosuppressive peptides in addition to the antigen of interest. Furthermore, in some embodiments, the particles do not contain other proteins or peptides (e.g. costimulatory molecules, MHC molecules, immunostimulatory peptides or immunosuppressive peptides) either on the surface or encapsulated within the particle.

Encapsulation of the antigen, biological, and/or chemical agents in the particle of the invention has been surprisingly found to induce immunological tolerance and has several advantages. First, the encapsulated particles have a slower cytokine response. Second, when using multiple antigens, biological, and/or chemical agents, encapsulation removes the competition between these various molecules that might occur if the agents were attached to the surface of the particle. Third, encapsulation allows more antigens, biological, and/or chemical agents to be incorporated with the particle. Fourth, encapsulation allows for easier use of complex protein antigens or organ homogenates (e.g. pancreas homogenate for type 1 diabetes or peanut extract in peanut allergy). Finally, encapsulation of antigens, biological, and/or chemical agents within the particle instead of conjugation to the surface of the particle maintains the net negative charge on the surface of the particle. The encapsulation of the antigen, biological, and/or chemical agents in the particles of the invention may be performed by any method known in the art. In one embodiment, polypeptide antigens are encapsulated in the particles by a double-emulsion process. In a further embodiment, the polypeptide antigens are water soluble.

In another embodiment, the polypeptide antigens are encapsulated in the particles by a single-emulsion process. In a further embodiment, the polypeptide antigens are more hydrophobic. Sometimes, the double emulsion process leads to the formation of large particles which may result in the leakage of the hydrophilic active component and low entrapment efficiencies. The coalescence and Ostwald ripening are two mechanisms that may destabilize the double-emulsion droplet, and the diffusion through the organic phase of the hydrophilic active component is the main mechanism responsible of low levels of entrapped active component. In some embodiments, it may be beneficial to reduce the nanoparticle size.

One strategy to accomplish this is to apply a second strong shear rate. The leakage effect can be reduced by using a high polymer concentration and a high polymer molecular mass, accompanied by an increase in the viscosity of the inner water phase and in increase in the surfactant molecular mass.

In certain embodiments, the present invention provides carriers having thereon (or therein) cells or other biological or chemical agents. Where cells are employed, the carriers are not limited to a particular type of cells. In some embodiments, the carriers have thereon pancreatic islet cells. In some embodiments, the microporous carriers additionally have thereon ECM proteins and/or exendin-4. The carriers are not limited to a particular type. In some embodiments, a carrier has regions of varying porosity (e.g., varying pore size, pore depth, and/or pore density). In some embodiments, carriers have thereon (or therein) pharmaceutical agents, DNA, RNA, extracellular matrix proteins, exendin-4, etc. In certain embodiments, the present invention provides methods for transplanting pancreatic islet cells with such carriers. In certain embodiments of this invention, the inducing antigen is a single isolated or recombinantly produced molecule. For treating conditions where the target antigen is disseminated to various locations in the host, it is generally necessary that the inducing antigen be identical to or immunologically related to the target antigen. Examples of such antigens are most polynucleotide antigens, and some carbohydrate antigens (such as blood group antigens).

Any suitable antigens may find use within the scope of the present invention. In some embodiments, the inducing antigen contributes to the specificity of the tolerogenic response that is induced. The inducing antigen may or may not be the same as the target antigen, which is the antigen present or to be placed in the subject being treated which is a target for the unwanted immunological response, and for which tolerance is desired.

Where the target antigen is preferentially expressed on a particular organ, cell, or tissue type, the practitioner again has the option of using an inducing antigen which is identical with or immunologically related to the target antigen. However, there is also the additional option of using an antigen which is a bystander for the target. This is an antigen which may not be immunologically related to the target antigen, but is preferentially expressed in a tissue where the target antigen is expressed. A working theory as to the effectiveness of bystander suppression is that suppression is an active cell-mediated process that down-regulates the effector arm of the immune response at the target cells. The suppressor cells are specifically stimulated by the inducer antigen at the mucosal surface, and home to a tissue site where the bystander antigen is preferentially expressed. Through an interactive or cytokine-mediated mechanism, the localized suppressor cells then down-regulate effector cells (or inducers of effector cells) in the neighborhood, regardless of what they are reactive against. If the effector cells are specific for a target different from the inducing antigen, then the result is a bystander effect. For further elaboration of the bystander reaction and a list of tolerogenic peptides having this effect, the reader is referred to International Patent Publication WO 93/16724. An implication of bystander theory is that one of ordinary skill need not identify or isolate a particular target antigen against which tolerance is desired in order to practice the present invention. The practitioner need only be able to obtain at least one molecule preferentially expressed at the target site for use as an inducing antigen.

In certain embodiments of this invention, the inducing antigen is not in the same form as expressed in the individual being treated, but is a fragment or derivative thereof. Inducing antigens of this invention include peptides based on a molecule of the appropriate specificity but adapted by fragmentation, residue substitution, labeling, conjugation, and/or fusion with peptides having other functional properties. The adaptation may be performed for any desirable purposes, including but not limited to the elimination of any undesirable property, such as toxicity or immunogenicity; or to enhance any desirable property, such as mucosal binding, mucosal penetration, or stimulation of the tolerogenic arm of the immune response. Terms such as insulin peptide, collagen peptide, and myelin basic protein peptide, as used herein, refer not only to the intact subunit, but also to allotypic and synthetic variants, fragments, fusion peptides, conjugates, and other derivatives that contain a region that is homologous (preferably 70% identical, more preferably 80% identical and even more preferably 90% identical at the amino acid level) to at least 10 and preferably 20 consecutive amino acids of the respective molecule for which it is an analog, wherein the homologous region of the derivative shares with the respective parent molecule an ability to induce tolerance to the target antigen.

It is recognized that tolerogenic regions of an inducing antigen are often different from immunodominant epitopes for the stimulation of an antibody response. Tolerogenic regions are generally regions that can be presented in particular cellular interactions involving T cells. Tolerogenic regions may be present and capable of inducing tolerance upon presentation of the intact antigen. Some antigens contain cryptic tolerogenic regions, in that the processing and presentation of the native antigen does not normally trigger tolerance. An elaboration of cryptic antigens and their identification is found in International Patent Publication WO 94/27634.

In certain embodiments of this invention, two, three, or a higher plurality of inducing antigens is used. It may be desirable to implement these embodiments when there are a plurality of target antigens, or to provide a plurality of bystanders for the target. For example, both insulin and glucagon can be mixed with a mucosal binding component in the treatment of diabetes. It may also be desirable to provide a cocktail of antigens to cover several possible alternative targets. For example, a cocktail of histocompatibility antigen fragments could be used to tolerize a subject in anticipation of future transplantation with an allograft of unknown phenotype. Allovariant regions of human leukocyte antigens are known in the art: e.g., Immunogenetics 29:231, 1989. In another example, a mixture of allergens may serve as inducing antigen for the treatment of atopy.

Inducing antigens can be prepared by a number of techniques known in the art, depending on the nature of the molecule. Polynucleotide, polypeptide, and carbohydrate antigens can be isolated from cells of the species to be treated in which they are enriched. Short peptides are conveniently prepared by amino acid synthesis. Longer proteins of known sequence can be prepared by synthesizing an encoding sequence or PCR-amplifying an encoding sequence from a natural source or vector, and then expressing the encoding sequence in a suitable bacterial or eukaryotic host cell.

In certain embodiments of this invention, the combination comprises a complex mixture of antigens obtained from a cell or tissue, one or more of which plays the role of inducing antigen. The antigens may be in the form of whole cells, either intact or treated with a fixative such as formaldehyde, glutaraldehyde, or alcohol. The antigens may be in the form of a cell lysate, created by detergent solubilization or mechanical rupture of cells or tissue, followed by clarification. The antigens may also be obtained by subcellular fractionation, particularly an enrichment of plasma membrane by techniques such as differential centrifugation, optionally followed by detergent solubilization and dialysis. Other separation techniques are also suitable, such as affinity or ion exchange chromatography of solubilized membrane proteins.

In one embodiment, the antigenic peptide or protein is an autoantigen, an alloantigen or a transplantation antigen. In yet another particular embodiment, the autoantigen is selected from the group consisting of myelin basic protein, collagen or fragments thereof, DNA, nuclear and nucleolar proteins, mitochondrial proteins and pancreatic p-cell proteins.

The invention provides for the induction of tolerance to an autoantigen for the treatment of autoimmune diseases by administering the antigen for which tolerance is desired. For example, autoantibodies directed against the myelin basic protein (MBP) are observed in patients with multiple sclerosis, and, accordingly, MBP antigenic peptides or proteins may be used in the invention to be delivered using the compositions of the present invention to treat and prevent multiple sclerosis.

By way of another non-limiting example, an individual who is a candidate for a transplant from a non-identical twin may suffer from rejection of the engrafted cells, tissues or organs, as the engrafted antigens are foreign to the recipient. Prior tolerance of the recipient individual to the intended graft abrogates or reduces later rejection. Reduction or elimination of chronic anti-rejection therapies may be achieved by the practice of the present invention. In another example, many autoimmune diseases are characterized by a cellular immune response to an endogenous or self-antigen. Tolerance of the immune system to the endogenous antigen is desirable to control the disease.

In a further example, sensitization of an individual to an industrial pollutant or chemical, such as may be encountered on-the-job, presents a hazard of an immune response. Prior tolerance of the individual's immune system to the chemical, in particular in the form of the chemical reacted with the individual's endogenous proteins, may be desirable to prevent the later occupational development of an immune response.

Allergens are other antigens for which tolerance of the immune response thereto is also desirable. In one embodiment, the antigen is a gliaden. In a further embodiment, the antigen is A-gliaden.

Notably, even in diseases where the pathogenic autoantigen is unknown, bystander suppression may be induced using antigens present in the anatomical vicinity. For example, autoantibodies to collagen are observed in rheumatoid arthritis and, accordingly, a collagen-encoding gene may be utilized as the antigen-expressing gene module in order to treat rheumatoid arthritis (see e.g. Choy (2000) Curr Opin Investig Drugs 1:58-62). Furthermore, tolerance to beta cell autoantigens may be utilized to prevent development of type 1 diabetes (see e.g. Bach and Chatenoud (2001) Ann Rev Immunol 19:131-161).

As another example, auto-antibodies directed against myelin oligodendrocyte glycoprotein (MOG) are observed in autoimmune encephalomyelitis and in many other CNS diseases as well as multiple sclerosis (see e.g. Iglesias et al. (2001) Glia 36:22-34). Accordingly, use of MOG antigen expressing constructs in the invention allows for treatment of multiple sclerosis as well as related autoimmune disorders of the central nervous system.

Still other examples of candidate autoantigens for use in treating autoimmune disease include: pancreatic beta-cell antigens, insulin and GAD to treat insulin-dependent diabetes mellitus; collagen type 11, human cartilage gp 39 (HCgp39) and gp130-RAPS for use in treating rheumatoid arthritis; myelin basic protein (MBP), proteo lipid protein (PLP) and myelin oligodendrocyte glycoprotein (MOG, see above) to treat multiple sclerosis; fibrillarin, and small nucleolar protein (snoRNP) to treat scleroderma; thyroid stimulating factor receptor (TSH-R) for use in treating Graves' disease; nuclear antigens, histones, glycoprotein gp70 and ribosomal proteins for use in treating systemic lupus erythematosus; pyruvate dehydrogenase dehydrolipoamide acetyltransferase (PCD-E2) for use in treating primary billiary cirrhosis; hair follicle antigens for use in treating alopecia areata; and human tropomyosin isoform 5 (hTM5) for use in treating ulcerative colitis.

In one embodiment, the particles of the invention are covalently coupled to antigens comprising one or more epitopes associated with allergies, autoimmune diseases and/or inflammatory diseases or disorders. The antigens may comprise one or more copies of an epitope. In one embodiment, the antigens comprise a single epitope associated with one disease or disorder. In a further embodiment, the antigens comprise more than one epitope associated with the same disease or disorder. In yet a further embodiment, the antigens comprise more than one epitope associated with different diseases or disorders. In a further embodiment, the antigens comprise one or more epitopes associated with one or more allergies. In a further embodiment, the antigens comprise one or more epitopes associated with multiple sclerosis, type 1 diabetes. Celiac's disease, and/or inflammatory bowel disease, including Crohn's disease or ulcerative colitis. In one embodiment, the epitopes are from myelin basic protein (e.g. SEQ ID NOs:4975 & 4976), proteolipid protein (e.g. SEQ ID NO: 4977), myelin oligodendrocyte glycoprotein (e.g. SEQ ID NOs: 1 & 4978), aquaporin, (e.g. SEQ ID NO: 4979), myelin associated glycoprotein (e.g. SEQ ID NO: 4980), insulin (e.g. SEQ ID NO: 4981), glutamic acid decarboxylase (e.g. SEQ ID NO: 4982), gliadin (e.g. SEQ ID NOs:4983-4985 or 5136-5140), the α3 chain of type IV collagen (e.g. SEQ ID NO: 5017), or fragments, homologs, or isoforms thereof. In a further embodiment, the epitopes are from gluten, including from gliadin and/or glutenin. In one embodiment, the epitopes are from insulin homologs, such as those described in U.S. Pat. No. 8,476,228 hereby incorporated in its entirety for all purposes. In one embodiment, the gliaden epitopes are SEQ ID NOs: 13, 14, 16, 320, or 321 in U.S. Application No. 20110293644, hereby incorporated in its entirety for all purposes.

Further non-limiting examples of epitopes associated with various autoimmune diseases and/or inflammatory diseases or disorders that are contemplated by the instant invention are described in Tables 2 and 3.

TABLE 2

Representative Linear Epitopes

| Disease | Representative Epitopes |
| --- | --- |
| Multiple Sclerosis | SEQ ID NOs: 2-1294 |
| Celiac Disease | SEQ ID NOs: 1295-1724; |
|  | SEQ ID NOs: 1726-1766; |
|  | SEQ ID NOs: 4986-5140 |
| Diabetes | SEQ ID NOs: 1767-1840; |
|  | SEQ ID NOs: 1842-1962; |
|  | SEQ ID NOs: 1964-2027; |
|  | SEQ ID NOs: 2029-2073; |
|  | SEQ ID NOs: 2075-2113; |
|  | SEQ ID NOs: 2115-2197; |

TABLE 2-continued

Representative Linear Epitopes

| Disease | Representative Epitopes |
|---|---|
| | SEQ ID NOs: 2199-2248; |
| | SEQ ID NOs: 2250-2259; |
| | SEQ ID NOs: 2261-2420; |
| | SEQ ID NOs: 2422-2486; |
| | SEQ ID NOs: 2489-2505 |
| Rheumatoid Arthritis | SEQ ID NOs: 2506-3260; |
| | SEQ ID NOs: 3262-3693 |
| Systemic Lupus Erythematosus | SEQ ID NOs: 3694-3857; |
| | SEQ ID NOs: 3860-4565 |
| Good Pasture's Syndrome | SEQ ID NOs: 4566-4576; |
| | SEQ ID NOs: 4578-4610; |
| | SEQ ID NOs: 4612-4613; |
| | SEQ ID NOs: 5018-5039 |
| Autoimmune Uveitis | SEQ ID NOs: 4614-4653 |
| Autoimmune Thyroiditis | SEQ ID NOs: 4654-4694; |
| | SEQ ID NOs: 4696-4894; |
| | SEQ ID NOs: 4896-4901 |
| Autoimmune Myositis | SEQ ID NOs: 4902-4906 |
| Autoimmune Vasculitis | SEQ ID NOs: 4907-4914 |
| Autoimmune Pancreatitis | SEQ ID NOs: 4915-4917 |
| Crohns Disease | SEQ ID NOs: 4918-4941 |
| Ulcerative Colitis | SEQ ID NOs: 4942-4952 |
| Psoriasis | SEQ ID NOs: 4953-4963 |
| Reactive Arthritis | SEQ ID NOs: 4964-4974 |

Not all epitopes are linear epitopes; epitopes can also be discontinuous, conformational epitopes. A number of discontinuous epitopes associated with autoimmune diseases or inflammatory diseases and/or disorders are known. Non-limiting examples of discontinuous epitopes are described in Table 3.

TABLE 3

Representative Discontinuous Epitopes

| Disease | Epitope | Full Length Polypeptide |
|---|---|---|
| Celiac Disease | D151, E153, E154, E155, E158; D306, N308, N310; D434, E435, E437, D438; E329; E153; R19, E153, M659; or C277, H335, D358 | Protein-glutamine gamma-glutamyltransferase 2 SEQ ID NO: 1725 |
| Diabetes | E517; R255, F256, K257, K263, E264, K265, L270, P271, R272, L273, L285, K286, K287, I294, G295, T296, D297, S298, R317, R318; N483, I484, I485, K486, N487, R488, E489, G490, Y491, E492, M493, V494, F495, D496, G497, K498, P499, F556, F557, R558, M559, V560, I561, S562, N563, P564, A565, A566, T567, H568, Q569, D570, I571, D572, F573, L574, I575, E576, E577, I578, E579, R580, L581, G582, Q583, D584, L585; E264; E517, E520, E521, S524, S527, V532; E517, E521; K358; R536, Y540 | Glutamate decarboxylase 2 SEQ ID NOs: 1841, 1963, 2114, & 2249 |
| Diabetes | P876, A877, E878, T880; T804; T804, V813, D821, R822, Q862, P886; T804, V813, D821, R822, Q862, P886; W799, E836, N858; D911; Q862; L831, H833, V834, E836, Q860; W799, E836, N858; W799, L831, H833, V834, Y835, E836, Q860; | protein tyrosine phosphatase, receptor type, N precursor SEQ ID NOs: 2028 & 2074 |
| Diabetes | R325, R332, E333, K336, K340; R325; W325 | zinc transporter 8 isoform a SEQ ID NO: 2421 |
| Diabetes | E872, C945 | Receptor-type tyrosine-protein SEQ ID NOs: 2198, 2260, & 2487 |
| Diabetes | W799, C909 | tyrosine phosphatase SEQ ID NO: 2488 |
| Rheumatoid Arthritis | L14, M15, I16, S17, R18, N147, G148, S187, M191, H196, N197, H198, Y199, Q201, S203 | Chain A, Crystal Structure A Human Igm Rheumatoid Factor Fab In Complex With Its Autoantigen Igg Fc SEQ ID NO: 3261 |
| Systemic Lupus Erythematosus | K591, S592, G593 | ATP-dependent DNA helicase 2 subunit 1 SEQ ID NO: 3858 |
| Systemic Lupus Erythematosus | M1, K2, L3, V4, R5, F6, L7, M8, K9, L10, S11, H12, E13, T14, V15, T16, I17, E18, L19, K20, N21, G22, T23, Q24, V25, H26, P85, K86, V87, K88, S89, K90, K91, R92, E93, A94, V95, A96, G97, R98, G99, R100, G101, R102, G103, R104, G105, R106, G107, R108, G109, R110, G111, R112, G113, R114, G115, G116, P117, R118, R119 | Small nuclear ribonucleoprotein Sm D1 SEQ ID NO: 3859 |
| Systemic Lupus Erythematosus | G59, R62 | beta-2-glycoprotein I SEQ ID NO: 4357 |
| Good Pasture's Syndrome | T24, A25, I26, S28, E31, V34, P35, S38, Q64 | type IV collagen alpha3 SEQ ID NO: 4577 |
| Good Pasture's Syndrome | T1455, A1456, I1457, S1459, E1462, T1464, V1465, P1466, Y1468, S1469, Q1495, T1537, T1565, P1569, H1572, K1579, A1634 | alpha3 type IV collagen SEQ ID NO: 4611 |
| Autoimmune Thyroiditis | E604, D620, K627, D630; R225, R646, D707; K627; R225; Y772; K713, F714, P715, E716; P715, D717 | Thyroid peroxidase SEQ ID NO: 4695 |
| Autoimmune Thyroiditis | D36, R38, K42, Q55, K58, I60, E61, R80, Y82, S84, T104, H105, E107, R109, N110, K129, F130, D151, F153, I155, E157, T181, K183, D203 | Thyrotropin receptor SEQ ID NO: 4895 |

Combinations of antigens and/or epitopes can be tested for their ability to promote tolerance by conducting experiments with isolated cells or in animal models.

In some embodiments, the tolerance inducing compositions of the present invention contain an immune modulating agent, such as rapamycin, tacrolimus, In some embodiments, the tolerance inducing compositions of the present invention contain an immune modulating agent such as a Janus Kinase antagonist and/or a Janus Kinase agonist.

In some embodiments, the tolerance inducing compositions of the present invention contain an immune modulating agent such as a cytokine and/or antibody to a cytokine.

In some embodiments, the tolerance inducing compositions of the present invention contain growth factors that may promote regulation of T cells. Such factors may include insulin, transforming growth factor beta, serum albumin and any other factor known to support immune cell regulation.

In some embodiments, the tolerance inducing compositions of the present invention contain antibodies that may promote tolerance induction.

In some embodiments, the tolerance inducing compositions of the present invention contain an apoptosis signaling molecule (e.g., in addition to an antigenic peptide or other antigenic molecule). In some embodiments, the apoptosis signaling molecule is coupled and/or associated with the surface of the carrier. In some embodiments an apoptotic signaling molecules allows a carrier to be perceived as an apoptotic body by antigen presenting cells of the host, such as cells of the host reticuloendothelial system; this allows presentation of the associated peptide epitopes in a tolerance-inducing manner. Without being bound by theory, this is presumed to prevent the upregulation of molecules involved in immune cell stimulation, such as MHC class 1/11, and costimulatory molecules. These apoptosis signaling molecules may also serve as phagocytic markers. For example, apoptosis signaling molecules suitable for the present invention have been described in US Pat App No. 20050113297, which is hereby incorporated by reference in its entirety. Molecules suitable for the present invention include molecules that target phagocytes, which include macrophages, dendritic cells, monocytes, granulocytes and neutrophils.

In some embodiments, molecules suitable as apoptotic signalling molecules act to enhance tolerance of the associated peptides. Additionally, a carrier bound to an apoptotic signaling molecule can be bound by Clq in apoptotic cell recognition (Paidassi et al., (2008) J. Immunol. 180:2329-2338; herein incorporated by reference in its entirety). For example, molecules that may be useful as apoptotic signalling molecules include phosphatidyl serine, annexin-1, annexin-5, milk fat globule-EGF-factor 8 (MFG-E8), or the family of thrombospondins (e.g., thrombospondin-1 (TSP-1)). Various molecules suitable for use as apoptotic signalling molecules with the present invention are discussed, for example, in U.S. Pat. App. 2012/0076831; herein incorporated by reference in its entirety).

In some embodiments, the apoptotic signalling molecule may be conjugated to the antigen-specific peptide. In some instances, the apoptotic signalling molecule and antigen-specific peptide are conjugated by the creation of a fusion protein. For example a fusion protein may comprise at least one antigen-specific peptide (or a fragment or a variant thereof) coupled to at least one molecule of an apoptotic signalling molecule (or a fragment or a variant thereof). For the creation of fusion proteins, the terms "fusion protein," "fusion peptide," "fusion polypeptide," and "chimeric peptide" are used interchangeably. Suitable fragments of the antigen-specific peptide include any fragment of the full-length peptide that retains the function of generating the desired antigen-specific tolerance function of the present invention. The fusion protein may be created by various means understood in the art (e.g., genetic fusion, chemical conjugation, etc.). The two proteins may be fused either directly or via an amino acid linker. The polypeptides forming the fusion protein are typically linked C-terminus to N-terminus, although they can also be linked C-terminus to C-terminus, N-terminus to N-terminus, or N-terminus to C-terminus. The polypeptides of the fusion protein can be in any order. A peptide linker sequence may be employed to separate the first and second polypeptide components by a distance sufficient to ensure that each polypeptide folds into its secondary and tertiary structures. Amino acid sequences which may be usefully employed as linkers include those disclosed in Maratea et. al., Gene 40:39-46 (1985); Murphy et al., Proc. Natl. Acad. Sci. USA 83:8258-8262 (1986); U.S. Pat. Nos. 4,935,233 and 4,751,180; herein incorporated by reference in their entireties. The linker sequence may generally be from 1 to about 50 amino acids in length. In some embodiments, linker sequences are not required and/or utilized, for example, when the first and second polypeptides have non-essential N-terminal amino acid regions that can be used to separate the functional domains and prevent steric interference.

A proxy for tolerogenic activity is the ability of an intact antigen or fragment to stimulate the production of an appropriate cytokine at the target site. The immunoregulatory cytokine released by T suppressor cells at the target site is thought to be TGF-β (Miller et al., Proc. Natl. Acad. Sci. USA 89:421, 1992). Other factors that may be produced during tolerance are the cytokines IL4 and IL-10, and the mediator PGE. In contrast, lymphocytes in tissues undergoing active immune destruction secrete cytokines such as IL-I, IL-2, IL-6, and y-IFN. Hence, the efficacy of a candidate inducing antigen can be evaluated by measuring its ability to stimulate the appropriate type of cytokines.

With this in mind, a rapid screening test for tolerogenic epitopes of the inducing antigen, effective mucosal binding components, effective combinations, or effective modes and schedules of mucosal administration can be conducted using syngeneic animals as donors for in vitro cell assays. Animals are treated at a mucosal surface with the test composition, and at some time are challenged with parenteral administration of the target antigen in complete Freund's adjuvant. Spleen cells are isolated, and cultured in vitro in the presence of the target antigen at a concentration of about 50 µg/mL. Target antigen can be substituted with candidate proteins or sub-fragments to map the location of tolerogenic epitopes. Cytokine secretion into the medium can be quantitated by standard immunoassay.

The ability of the cells to suppress the activity of other cells can be determined using cells isolated from an animal immunized with the target antigen, or by creating a cell line responsive to the target antigen (Ben-Nun et al., Eur. J. Immunol. 11:195, 1981, herein incorporated by reference in its entirety). In one variation of this experiment, the suppressor cell population is mildly irradiated (about 1000 to 1250 rads) to prevent proliferation, the suppressors are co-cultured with the responder cells, and then tritiated thymidine incorporation (or MTT) is used to quantitate the proliferative activity of the responders. In another variation, the suppressor cell population and the responder cell population are cultured in the upper and lower levels of a dual chamber transwell culture system (Costar, Cambridge Mass.), which permits the populations to coincubate within 1 mm of each other, separated by a polycarbonate membrane (WO 93/16724). In this approach, irradiation of the suppressor cell population is unnecessary, since the proliferative activity of the responders can be measured separately.

In embodiments of the invention where the target antigen is already present in the individual, there is no need to isolate the antigen or precombine it with the mucosal binding component. For example, the antigen may be expressed in the individual in a certain fashion as a result of a pathological condition (such as inflammatory bowel disease or Celiac disease) or through digestion of a food allergen. Testing is performed by giving the mucosal binding component in one or more doses or formulations, and determining its ability to promote tolerization against the antigen in situ.

The effectiveness of compositions and modes of administration for treatment of specific disease can also be elaborated in a corresponding animal disease model. The ability of the treatment to diminish or delay the symptomatology of the disease is monitored at the level of circulating biochemical and immunological hallmarks of the disease, immunohistology of the affected tissue, and gross clinical features as appropriate for the model being employed. Non-limiting examples of animal models that can be used for testing are included in the following section.

The invention contemplates modulation of tolerance by modulating THI response, TH2 response, TH17 response, or a combination of these responses. Modulating THI response encompasses changing expression of, e.g., interferon-gamma. Modulating TH2 response encompasses changing expression of, e.g., any combination of IL-4, IL-5, IL-10, and IL-13. Typically an increase (decrease) in TH2 response will comprise an increase (decrease) in expression of at least one of IL-4, IL-5, IL-10, or IL-13; more typically an increase (decrease) in TH2 response will comprise an increase in expression of at least two of IL-5, IL-10, or EL-13, most typically an increase (decrease) in TH2 response will comprise an increase in at least three of DL-4, IL-5, IL-10, or IL-13, while ideally an increase (decrease) in TH2 response will comprise an increase (decrease) in expression of all of IL-4, IL-10, and IL-13. Modulating TH 17 encompasses changing expression of, e.g., TGF-beta, IL-6, IL-21 and IL23, and effects levels of IL-17, IL-21 and IL-22.

Other suitable methods for assessing the effectiveness of compositions and methods of the present invention are understood in the art, as are discussed, for example, in U.S. Pat. App. 2012/0076831 (herein incorporated by reference in its entirety).

Certain embodiments of this invention relate to priming of immune tolerance in an individual not previously tolerized by therapeutic intervention. These embodiments generally involve a plurality of administrations of a combination of antigen and mucosal binding component. Typically, at least three administrations, frequently at least four administrations, and sometimes at least six administrations are performed during priming in order to achieve a long-lasting result, although the subject may show manifestations of tolerance early in the course of treatment. Most often, each dose is given as a bolus administration, but sustained formulations capable of mucosal release are also suitable. Where multiple administrations are performed, the time between administrations is generally between 1 day and 3 weeks, and typically between about 3 days and 2 weeks. Generally, the same antigen and mucosal binding component are present at the same concentration, and the administration is given at the same mucosal surface, but variations of any of these variables during a course of treatment may be accommodated.

Other embodiments of this invention relate to boosting or extending the persistence of a previously established immune tolerance. These embodiments generally involve one administration or a short course of treatment at a time when the established tolerance is declining or at risk of declining. Boosting is generally performed 1 month to 1 year, and typically 2 to 6 months after priming or a previous boost. This invention also includes embodiments that involve regular maintenance of tolerance on a schedule of administrations that occur semiweekly, weekly, biweekly, or on any other regular schedule.

The particles of the current invention can be given in any dose effective to dampen the inflammatory immune response in a subject in need thereof or to treat a bacterial or viral infection in a subject in need thereof. In certain embodiments, about $10^2$ to about $10^{20}$ particles are provided to the individual. In a further embodiment between about $10^3$ to about $10^{15}$ particles are provided. In yet a further embodiment between about $10^6$ to about $10^{12}$ particles are provided. In still a further embodiment between about $10^8$ to about $10^{10}$ particles are provided. In a preferred embodiment the preferred dose is 0.1% solids/ml. Therefore, for 0.5 □m beads, a preferred dose is approximately $4 \times 10^9$ beads, for 0.05 □m beads, a preferred dose is approximately $4 \times 10^{12}$ beads, for 3 □m beads, a preferred dose is $2 \times 10^7$ beads. In some embodiments, the particle dose is about 25 mg/mL to about 50 mg/mL. In some embodiments, the particle dose is about 50 mg/mL to about 100 mg/mL. In some embodiments, the particle dose is about 100 mg/mL to about 150 mg/mL. In some embodiments, the particle dose is about 150 mg/mL to about 200 mg/mL. In some embodiments, the particle dose is about 200 mg/mL to about 250 mg/mL. In some embodiments, the particle dose is about 250 mg/mL to about 300 mg/mL. In some embodiments, the particle dose is about 300 mg/mL or more. However, any dose that is effective in treating the particular condition to be treated is encompassed by the current invention.

The invention is useful for treatment of immune related disorders such as autoimmune disease, transplant rejection, enzyme deficiencies and allergic reactions. Substitution of a synthetic, biocompatible particle system to induce immune tolerance could lead to ease of manufacturing, broad availability of therapeutic agents, increase uniformity between samples, increase the number of potential treatment sites and dramatically reduce the potential for allergic responses to a carrier cell.

As used herein, the term "immune response" includes T cell mediated and/or B cell mediated immune responses. Exemplary immune responses include T cell responses, e.g., cytokine production and cellular cytotoxicity. In addition, the term immune response includes immune responses that are indirectly effected by T cell activation, e.g., antibody production (humoral responses) and activation of cytokine responsive cells, e.g., macrophages. Immune cells involved in the immune response include lymphocytes, such as B cells and T cells ($CD4^+$, $CD8^+$, Th1 and Th2 cells); antigen presenting cells (e.g., professional antigen presenting cells such as dendritic cells, macrophages, B lymphocytes, Langerhans cells, and nonprofessional antigen presenting cells such as keratinocytes, endothelial cells, astrocytes, fibroblasts, oligodendrocytes); natural killer cells; myeloid cells, such as macrophages, eosinophils, mast cells, basophils, and granulocytes. In some embodiments, the modified particles of the present invention are effective to reduce inflammatory cell trafficking to the site of inflammation.

As used herein, the term "anergy," "tolerance," or "antigen-specific tolerance" refers to insensitivity of T cells to T cell receptor-mediated stimulation. Such insensitivity is generally antigen-specific and persists after exposure to the antigenic peptide has ceased. For example, anergy in T cells is characterized by lack of cytokine production, e.g., IL-2. T-cell anergy occurs when T cells are exposed to antigen and receive a first signal (a T cell receptor or CD-3 mediated signal) in the absence of a second signal (a costimulatory signal). Under these conditions, re-exposure of the cells to the same antigen (even if re-exposure occurs in the presence of a costimulatory molecule) results in failure to produce cytokines and subsequently failure to proliferate. Thus, a failure to produce cytokines prevents proliferation. Anergic T cells can, however, proliferate if cultured with cytokines (e.g., IL-2). For example, T cell anergy can also be observed by the lack of IL-2 production by T lymphocytes as measured by ELISA or by a proliferation assay using an indicator cell line. Alternatively, a reporter gene construct can be used. For example, anergic T cells fail to initiate DL-2 gene transcription induced by a heterologous promoter under the control of the 5' IL-2 gene enhancer or by a multimer of the API sequence that can be found within the enhancer (Kang et al. 1992 Science. 257:1134).

As used herein, the term "immunological tolerance" refers to methods performed on a proportion of treated subjects in comparison with untreated subjects where: a) a decreased level of a specific immunological response (thought to be mediated at least in part by antigen-specific effector T lymphocytes, B lymphocytes, antibody, or their equivalents); b) a delay in the onset or progression of a specific immunological response; or c) a reduced risk of the onset or progression of a specific immunological response. "Specific" immunological tolerance occurs when immunological tolerance is preferentially invoked against certain antigens in comparison with others. "Non-Specific" immunological tolerance occurs when immunological tolerance is invoked indiscriminately against antigens which lead to an inflammatory immune response. "Quasi-Specific" immunological tolerance occurs when immunological tolerance is invoked semi-discriminately against antigens which lead to a pathogenic immune response but not to others which lead to a protective immune response.

Tolerance to autoantigens and autoimmune disease is achieved by a variety of mechanisms including negative selection of self-reactive T cells in the thymus and mechanisms of peripheral tolerance for those autoreactive T cells that escape thymic deletion and are found in the periphery. Examples of mechanisms that provide peripheral T cell tolerance include "ignorance" of self-antigens, anergy or unresponsiveness to autoantigen, cytokine immune deviation, and activation-induced cell death of self-reactive T cells. In addition, regulatory T cells have been shown to be involved in mediating peripheral tolerance. See, for example, Walker et al. (2002) Nat. Rev. Immunol. 2:11-19; Shevach et al. (2001) Immunol. Rev. 182:58-67. In some situations, peripheral tolerance to an autoantigen is lost (or broken) and an autoimmune response ensues. For example, in an animal model for EAE, activation of antigen presenting cells (APCs) through TLR innate immune receptors was shown to break self-tolerance and result in the induction of EAE (Waldner et al. (2004) J. Clin. Invest. 113:990-997).

Accordingly, in some embodiments, the invention provides methods for increasing antigen presentation while suppressing or reducing TLR7/8, TLR9, and/or TLR 7/8/9 dependent cell stimulation. As described herein, administration of particular modified particles results in antigen presentation by DCs or APCs while suppressing the TLR 7/8, TLR9, and/or TLR7/8/9 dependent cell responses associated with immunostimulatory polynucleotides. Such suppression may include decreased levels of one or more TLR-associated cytokines.

As discussed above this invention provides novel compounds that have biological properties useful for the treatment of Mac-1 and LFA-1 mediated disorders.

Pharmaceutical Compositions

Accordingly, in another aspect of the present invention, pharmaceutical compositions are provided, which comprise the tolerizing immune modifying particles and optionally comprise a pharmaceutically acceptable carrier. In certain embodiments, these compositions optionally further comprise one or more additional therapeutic agents. Alternatively, the modified particles of the current invention may be administered to a patient in need thereof in combination with the administration of one or more other therapeutic agents. For example, additional therapeutic agents for conjoint administration or inclusion in a pharmaceutical composition with a compound of this invention may be an approved anti-inflammatory agent, or it may be any one of a number of agents undergoing approval in the Food and Drug Administration that ultimately obtain approval for the treatment of any disorder characterized by an uncontrolled inflammatory immune response or a bacterial or viral infection. It will also be appreciated that certain of the modified particles of present invention can exist in free form for treatment, or where appropriate, as a pharmaceutically acceptable derivative thereof.

The pharmaceutical compositions of the present invention additionally comprise a pharmaceutically acceptable carrier, which, as used herein, includes any and all solvents, diluents, or other liquid vehicle, dispersion or suspension aids, surface active agents, isotonic agents, thickening or emulsifying agents, preservatives, solid binders, lubricants and the like, as suited to the particular dosage form desired. Remington's Pharmaceutical Sciences, Sixteenth Edition, E. W. Martin (Mack Publishing Co., Easton, Pa., 1980) discloses various carriers used in formulating pharmaceutical compositions and known techniques for the preparation thereof. Except insofar as any conventional carrier medium is incompatible with the compounds of the invention, such as by producing any undesirable biological effect or otherwise interacting in a deleterious manner with any other component(s) of the pharmaceutical composition, its use is contemplated to be within the scope of this invention. Some examples of materials which can serve as pharmaceutically acceptable carriers include, but are not limited to, sugars such as lactose, glucose and sucrose; starches such as corn starch and potato starch; cellulose and its derivatives such as sodium carboxymethyl cellulose, ethyl cellulose and cellulose acetate; powdered tragacanth; malt; gelatine; talc; excipients such as cocoa butter and suppository waxes; oils such as peanut oil, cottonseed oil; safflower oil, sesame oil; olive oil; corn oil and soybean oil; glycols; such as propylene glycol; esters such as ethyl oleate and ethyl laurate; agar; buffering agents such as magnesium hydroxide and aluminum hydroxide; alginic acid; pyrogen free water; isotonic saline; Ringer's solution; ethyl alcohol, and phosphate buffer solutions, as well as other non-toxic compatible lubricants such as sodium lauryl sulfate and magnesium stearate, as well as coloring agents, releasing agents, coating agents, sweetening, flavoring and perfuming agents, preservatives and antioxidants can also be present in the composition, according to the judgment of the formulator.

Liquid dosage forms for oral administration include, but are not limited to, pharmaceutically acceptable emulsions, microemulsions, solutions, suspensions, syrups and elixirs.

In addition to the active compounds, the liquid dosage forms may contain inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, the oral compositions can also include adjuvants such as wetting agents, emulsifying and suspending agents, sweetening, flavoring, and perfuming agents.

The particles of the invention may be administered orally, nasally, intravenously, intramuscularly, ocularly, transdermally, intraperitoneally, or subcutaneously. In one embodiment, the particles of the invention are administered intravenously.

Administration

The effective amounts and method of administration of the present invention for modulation of an immune response can vary based on the individual, what condition is to be treated and other factors evident to one skilled in the art. Factors to be considered include route of administration and the number of doses to be administered. Such factors are known in the art and it is well within the skill of those in the art to make such determinations without undue experimentation. A suitable dosage range is one that provides the desired regulation of immune. Useful dosage ranges of the carrier, given in amounts of carrier delivered, may be, for example, from about any of the following: 0.5 to 10 mg/kg, 1 to 9 mg/kg, 2 to 8 mg/kg, 3 to 7 mg/kg, 4 to 6 mg/kg, 5 mg/kg, 1 to 10 mg/kg, 5 to 10 mg/kg. Alternatively, the dosage can be administered based on the number of particles. For example, useful dosages of the carrier, given in amounts of carrier delivered, may be, for example, about $10^6$, $10^7$, $10^8$, $10^9$, $10^{10}$, or greater number of particles per dose. The absolute amount given to each patient depends on pharmacological properties such as bioavailability, clearance rate and route of administration. Details of pharmaceutically acceptable carriers, diluents and excipients and methods of preparing pharmaceutical compositions and formulations are provided in Remington's Pharmaceutical Sciences $18^{th}$ Edition, 1990, Mack Publishing Co., Easton, Pa., USA., which is hereby incorporated by reference in its entirety.

The effective amount and method of administration of the particular carrier formulation can vary based on the individual patient, desired result and/or type of disorder, the stage of the disease and other factors evident to one skilled in the art. The route(s) of administration useful in a particular application are apparent to one of skill in the art. Routes of administration include but are not limited to topical, dermal, transdermal, transmucosal, epidermal, parenteral, gastrointestinal, and naso-pharyngeal and pulmonary, including transbronchial and transalveolar. A suitable dosage range is one that provides sufficient IRP-containing composition to attain a tissue concentration of about 1-50 µM as measured by blood levels. The absolute amount given to each patient depends on pharmacological properties such as bioavailability, clearance rate and route of administration.

The present invention provides carrier formulations suitable for topical application including, but not limited to, physiologically acceptable implants, ointments, creams, rinses and gels. Exemplary routes of dermal administration are those which are least invasive such as transdermal transmission, epidermal administration and subcutaneous injection.

Transdermal administration is accomplished by application of a cream, rinse, gel, etc. capable of allowing the carrier to penetrate the skin and enter the blood stream. Compositions suitable for transdermal administration include, but are not limited to, pharmaceutically acceptable suspensions, oils, creams and ointments applied directly to the skin or incorporated into a protective carrier such as a transdermal device (so-called "patch"). Examples of suitable creams, ointments etc. can be found, for instance, in the Physician's Desk Reference. Transdermal transmission may also be accomplished by iontophoresis, for example using commercially available patches which deliver their product continuously through unbroken skin for periods of several days or more. Use of this method allows for controlled transmission of pharmaceutical compositions in relatively great concentrations, permits infusion of combination drugs and allows for contemporaneous use of an absorption promoter.

Parenteral routes of administration include but are not limited to electrical (iontophoresis) or direct injection such as direct injection into a central venous line, intravenous, intramuscular, intraperitoneal, intradermal, or subcutaneous injection. Formulations of carrier suitable for parenteral administration are generally formulated in USP water or water for injection and may further comprise pH buffers, salts bulking agents, preservatives, and other pharmaceutically acceptable excipients. Immunoregulatory polynucleotide for parenteral injection may be formulated in pharmaceutically acceptable sterile isotonic solutions such as saline and phosphate buffered saline for injection.

Gastrointestinal routes of administration include, but are not limited to, ingestion and rectal routes and can include the use of, for example, pharmaceutically acceptable powders, pills or liquids for ingestion and suppositories for rectal administration.

Naso-pharyngeal and pulmonary administration include are accomplished by inhalation, and include delivery routes such as intranasal, transbronchial and transalveolar routes. The invention includes formulations of carrier suitable for administration by inhalation including, but not limited to, liquid suspensions for forming aerosols as well as powder forms for dry powder inhalation delivery systems. Devices suitable for administration by inhalation of carrier formulations include, but are not limited to, atomizers, vaporizers, nebulizers, and dry powder inhalation delivery devices.

Injectable preparations, for example, sterile injectable aqueous or oleaginous suspensions may be formulated according to the known art using suitable dispersing or wetting agents and suspending agents. The sterile injectable preparation may also be a sterile injectable solution, suspension or emulsion in a nontoxic parenterally acceptable diluent or solvent, for example, as a solution in 1,3-butanediol. Among the acceptable vehicles and solvents that may be employed are water, Ringer's solution, U.S.P. and isotonic sodium chloride solution. In addition, sterile, fixed oils are conventionally employed as a solvent or suspending medium. For this purpose any bland fixed oil can be employed including synthetic mono- or diglycerides. In addition, fatty acids such as oleic acid are used in the preparation of injectables.

The injectable formulations can be sterilized, for example, by filtration through a bacterial-retaining filter, or by incorporating sterilizing agents in the form of sterile solid compositions which can be dissolved or dispersed in sterile water or other sterile injectable medium prior to use.

In order to prolong the effect of a drug, it is often desirable to slow the absorption of the drug from subcutaneous or intramuscular injection. This may be accomplished by the use of a liquid suspension or crystalline or amorphous material with poor water solubility. The rate of absorption of the drug then depends upon its rate of dissolution that, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include (poly(orthoesters) and poly(anhydrides). Depot injectable formulations are also prepared by entrapping the drug in liposomes or microemulsions which are compatible with body tissues.

In some embodiments, the synthetic, biodegradable particles of the present invention provide ease of manufacturing, broad availability of therapeutic agents, and increased treatment sites. Experiments conducted during development of embodiments of the present invention demonstrated the conjugation of peptides (e.g., PLP139-151 peptide) to these particles. Such peptide-coupled particles have shown that they are effective for the prevention of disease development and the induction of immunological tolerance (e.g., in the SJL/J PLP139-151/CFA-induced R-EAE murine model of multiple sclerosis). Peptide coupled carriers of the present invention provide numerous advantages over other tolerance induction structures. In some embodiments, the particles are biodegradable, and therefore will not persist for long times in the body. The time for complete degradation can be controlled. In some embodiments, particles are functionalized to facilitate internalization without cell activation (e.g., phosphatidylserine loaded into PLG microspheres). In some embodiments, particles incorporate targeting ligands for a specific cell population. In some embodiments, anti-inflammatory cytokines such as IL-10 and TGF-β, are included on or within particles to limit activation of the cell type that is internalizing the particles and to facilitate the induction of tolerance via energy and/or deletion and the activation of regulatory T cells. The composition of the particles has been found to affect the length of time the particles persist in the body and tolerance requires rapid particle uptake and clearance/degradation. Since ratios of over 50:50 lactide:glycolide slow the degradation rate, the particles of the invention have a lactide:glycolide ratio of about 50:50 or below. In one embodiment the particles of the invention have about a 50:50 D,L-lactide:glycolide ratio.

Solid dosage forms for oral administration include capsules, tablets, pills, powders, and granules. In such solid dosage forms, the modified particles are mixed with at least one inert, pharmaceutically acceptable excipient or carrier such as sodium citrate or dicalcium phosphate and/or a) fillers or extenders such as starches, lactose, sucrose, glucose, mannitol, and silicic acid, b) binders such as, for example, carboxymethylcellulose, alginates, gelatin, polyvinylpyrrolidinone, sucrose, and acacia, c) humectants such as glycerol, d) disintegrating agents such as agar-agar, calcium carbonate, potato or tapioca starch, alginic acid, certain silicates, and sodium carbonate, e) solution retarding agents such as paraffin, f) absorption accelerators such as quaternary ammonium compounds, g) wetting agents such as, for example, cetyl alcohol and glycerol monostearate, h) absorbents such as kaolin and bentonite clay, and i) lubricants such as talc, calcium stearate, magnesium stearate, solid polyethylene glycols, sodium lauryl sulfate, and mixtures thereof. In the case of capsules, tablets and pills, the dosage form may also comprise buffering agents.

Solid compositions of a similar type may also be employed as fillers in soft and hard-filled gelatin capsules using such excipients as lactose or milk sugar as well as high molecular weight polyethylene glycols and the like. The solid dosage forms of tablets, dragees, capsules, pills, and granules can be prepared with coatings and shells such as enteric coatings and other coatings well known in the pharmaceutical formulating art. They may optionally contain opacifying agents and can also be of a composition that they release the active ingredient(s) only, or preferentially, in a certain part of the intestinal tract, optionally, in a delayed manner. Examples of embedding compositions that can be used include polymeric substances and waxes. Solid compositions of a similar type may also be employed as fillers in soft and hard-filled gelatin capsules using such excipients as lactose or milk sugar as well as high molecular weight polyethylene glycols and the like.

The modified particles can also be in micro-encapsulated form with one or more excipients as noted above. The solid dosage forms of tablets, dragees, capsules, pills, and granules can be prepared with coatings and shells such as enteric coatings, release controlling coatings and other coatings well known in the pharmaceutical formulating art. In such solid dosage forms the active compound may be admixed with at least one inert diluent such as sucrose, lactose and starch. Such dosage forms may also comprise, as in normal practice, additional substances other than inert diluents, e.g., tableting lubricants and other tableting aids such as magnesium stearate and microcrystalline cellulose. In the case of capsules, tablets and pills, the dosage forms may also comprise buffering agents. They may optionally contain opacifying agents and can also be of a composition that they release the modified particles only, or preferentially, in a certain part of the intestinal tract, optionally, in a delayed manner. Examples of embedding compositions which can be used include polymeric substances and waxes.

The present invention encompasses pharmaceutically acceptable topical formulations of the inventive modified particles. The term "pharmaceutically acceptable topical formulation", as used herein, means any formulation which is pharmaceutically acceptable for intradermal administration of modified microparticles of the invention by application of the formulation to the epidermis. In certain embodiments of the invention, the topical formulation comprises a carrier system. Pharmaceutically effective carriers include, but are not limited to, solvents (e.g., alcohols, poly alcohols, water), creams, lotions, ointments, oils, plasters, liposomes, powders, emulsions, microemulsions, and buffered solutions (e.g., hypotonic or buffered saline) or any other carrier known in the art for topically administering pharmaceuticals. A more complete listing of art-known carriers is provided by reference texts that are standard in the art, for example, Remington's Pharmaceutical Sciences, 16th Edition, 1980 and 17th Edition, 1985, both published by Mack Publishing Company, Easton, Pa., the disclosures of which are incorporated herein by reference in their entireties. In certain other embodiments, the topical formulations of the invention may comprise excipients. Any pharmaceutically acceptable excipient known in the art may be used to prepare the inventive pharmaceutically acceptable topical formulations. Examples of excipients that can be included in the topical formulations of the invention include, but are not limited to, preservatives, antioxidants, moisturizers, emollients, buffering agents, solubilizing agents, other penetration agents, skin protectants, surfactants, and propellants, and/or additional therapeutic agents used in combination to the modified particles. Suitable preservatives include, but are not limited to, alcohols, quaternary amines, organic acids, parabens, and phenols. Suitable antioxidants include, but are not limited to, ascorbic acid and its esters, sodium bisulfite, butylated hydroxytoluene, butylated hydroxyanisole, tocopherols, and chelating agents like EDTA and citric acid. Suitable moisturizers include, but are not limited to, glycerine, sorbitol, polyethylene glycols, urea, and propylene glycol. Suitable buffering agents for use with the invention include, but are not limited to, citric, hydrochloric, and lactic acid buffers. Suitable solubilizing agents include, but are not limited to, quaternary ammonium chlorides, cyclodextrins, benzyl benzoate, lecithin, and polysorbates. Suitable skin protectants that can be used in the topical formulations of the invention include, but are not limited to, vitamin E oil, allantoin, dimethicone, glycerin, petrolatum, and zinc oxide.

In certain embodiments, the pharmaceutically acceptable topical formulations of the invention comprise at least the modified particles of the invention and a penetration enhancing agent. The choice of topical formulation will depend or several factors, including the condition to be treated, the physicochemical characteristics of the inventive compound and other excipients present, their stability in the formulation, available manufacturing equipment, and costs constraints. As used herein the term "penetration enhancing agent" means an agent capable of transporting a pharmacologically active compound through the stratum corneum and into the epidermis or dermis, preferably, with little or no systemic absorption. A wide variety of compounds have been evaluated as to their effectiveness in enhancing the rate of penetration of drugs through the skin. See, for example, Percutaneous Penetration Enhancers, Maibach H. I. and Smith H. E. (eds.), CRC Press, Inc., Boca Raton, Fla. (1995), which surveys the use and testing of various skin penetration enhancers, and Buyuktimkin et al., Chemical Means of Transdermal Drug Permeation Enhancement in Transdermal and Topical Drug Delivery Systems, Gosh T. K., Pfister W. R., Yum S. I. (Eds.), Interpharm Press Inc., Buffalo Grove, Ill. (1997). In certain exemplary embodiments, penetration agents for use with the invention include, but are not limited to, triglycerides (e.g., soybean oil), aloe compositions (e.g., aloe-vera gel), ethyl alcohol, isopropyl alcohol, octolyphenylpolyethylene glycol, oleic acid, polyethylene glycol 400, propylene glycol, N-decylmethylsulfoxide, fatty acid esters (e.g., isopropyl myristate, methyl laurate, glycerol monooleate, and propylene glycol monooleate) and N-methylpyrrolidone.

In certain embodiments, the compositions may be in the form of ointments, pastes, creams, lotions, gels, powders, solutions, sprays, inhalants or patches. In certain exemplary embodiments, formulations of the compositions according to the invention are creams, which may further contain saturated or unsaturated fatty acids such as stearic acid, palmitic acid, oleic acid, palmito-oleic acid, cetyl or oleyl alcohols, stearic acid being particularly preferred. Creams of the invention may also contain a non-ionic surfactant, for example, polyoxy-40-stearate. In certain embodiments, the active component is admixed under sterile conditions with a pharmaceutically acceptable carrier and any needed preservatives or buffers as may be required. Ophthalmic formulation, eardrops, and eye drops are also contemplated as being within the scope of this invention. Additionally, the present invention contemplates the use of transdermal patches, which have the added advantage of providing controlled delivery of a compound to the body. Such dosage forms are made by dissolving or dispensing the compound in the proper medium. As discussed above, penetration enhancing agents can also be used to increase the flux of the compound across the skin. The rate can be controlled by either providing a rate controlling membrane or by dispersing the compound in a polymer matrix or gel.

The modified particles can be administered by aerosol. This is accomplished by preparing an aqueous aerosol, liposomal preparation or solid particles containing the modified particles. A nonaqueous (e.g., fluorocarbon propellant) suspension could be used.

Ordinarily, an aqueous aerosol is made by formulating an aqueous solution or suspension of the agent together with conventional pharmaceutically acceptable carriers and stabilizers. The carriers and stabilizers vary with the requirements of the particular compound, but typically include nonionic surfactants (Tweens, PLURONIC®, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

It will also be appreciated that the modified particles and pharmaceutical compositions of the present invention can be formulated and employed in combination therapies, that is, the compounds and pharmaceutical compositions can be formulated with or administered concurrently with, prior to, or subsequent to, one or more other desired therapeutics or medical procedures. The particular combination of therapies (therapeutics or procedures) to employ in a combination regimen will take into account compatibility of the desired therapeutics and/or procedures and the desired therapeutic effect to be achieved. It will also be appreciated that the therapies employed may achieve a desired effect for the same disorder (for example, an inventive compound may be administered concurrently with another anti-inflammatory agent), or they may achieve different effects (e.g., control of any adverse effects).

In certain embodiments, the pharmaceutical compositions containing the modified particles of the present invention further comprise one or more additional therapeutically active ingredients (e.g., anti-inflammatory and/or palliative). For purposes of the invention, the term "Palliative" refers to treatment that is focused on the relief of symptoms of a disease and/or side effects of a therapeutic regimen, but is not curative. For example, palliative treatment encompasses painkillers, antinausea medications and anti-sickness drugs.

The invention provides methods of regulating an immune response in an individual, preferably a mammal, more preferably a human, comprising administering to the individual the modified particles described herein. Methods of immunoregulation provided by the invention include those that suppress and/or inhibit an innate immune response or an adaptive immune response, including, but not limited to, an immune response stimulated by immunostimulatory polypeptides or viral or bacterial components.

The modified particles are administered in an amount sufficient to regulate an immune response. As described herein, regulation of an immune response may be humoral and/or cellular, and is measured using standard techniques in the art and as described herein.

In some embodiments, compositions described herein are administered along with (e.g., concurrent with, prior to, or following) an implant (e.g., device) and/or transplant (e.g., tissue, cells, organ) to mediate, negate, regulate and/or reduce the immune response associated therewith.

Indications

In certain embodiments, the individual suffers from a disorder associated with unwanted immune activation, such as allergic disease or condition, allergy and asthma. An individual having an allergic disease or asthma is an individual with a recognizable symptom of an existing allergic disease or asthma. Tolerance can be induced in such an individual, for example, by particles complexed with the specific foods (e.g. peanut proteins, etc.), injected substances (e.g. bee venom proteins, etc.), or inhaled substances (e.g. ragweed pollen proteins, pet dander proteins, etc.) which elicit the allergic reaction.

In certain embodiments, the individual suffers from a disorder associated with unwanted immune activation, such as autoimmune disease and inflammatory disease. An individual having an autoimmune disease or inflammatory disease is an individual with a recognizable symptom of an existing autoimmune disease or inflammatory disease. Tolerance can be induced in such an individual, for example, by particles complexed with the relevant autoantigens driving the particular autoimmune disease.

In certain embodiments, the individual suffers from a disorder associated with enzyme replacement therapy. Tolerance can be induced in such an individual, for example, by particles covalently coupled with the enzymes which patients with genetic deficiencies fail to produce, to prevent them from making neutralizing antibody responses to recombinantly-produced enzymes administered to treat their particular deficiency, e.g. tolerance to human Factor VIII in patients with hemophilia due to a genetic deficiency in the ability to make Factor VIII. Another example may include enzyme replacement in for conditions such as mucopolysaccharide storage disorder, gangliosidosis, alkaline hypophosphatasia, cholesterol ester storage disease, hyperuricemia, growth hormone deficiency, renal anemia or with lysomal storage disorders including Fabry's disease, Gaucher's disease, Hurler's disease, Hunter's syndrome, Maroteaux-Lamy disease, Niemann-Pick disease, Tay-Sachs disease, and Pompe disease.

In certain embodiments, the individual suffers from a robust, or otherwise adverse, immune response towards an agent administered for the treatment of a disease that actually or potentially compromises patient health or treatment. Additionally, novel compounds provided by this invention may be provided to individuals who do not show an immune response to an agent but may potentially do so in the future. In certain embodiments, the individual is receiving enzyme replacement therapy. In certain embodiments, therapeutic agents include, but are not limited to, peptides or protein-based agents, DNA vaccines, siRNA, splice-site switching oligomers, and RNA-based nanoparticles. In some embodiments, the therapeutic agents include, but are not limited to, Advate, antihemophilic factor, Kogenate, Eloctate, recombinant factor VIII Fc fusion protein, Refacto, Novo VIIa, recombinant factor VII, eptacog alfa, Helixate, Monanine, Coagulation Factor IX, Wilate, Ceredase, Alglucerase, Cerezyme, Imiglucerase, Elelso, taliglucerase alfa, Fabrazyme, Agalsidase beta, Aldurazyme, -I-iduronidase, Myozyme, Acid-glucosidase, Elaprase, iduronate-2-sulfatase, Naglazyme arylsufatase B, and N-acetylgalactosamine-4-sulfatase. In some embodiments, the individual is administered therapeutic agents administered to treat diseases including, but not limited to, Hemophilia, Hemophilia A, Hemophilia B, von Willebrand disease, Gaucher's Disease, Fabry's Disease, Hurler's Disease, Pompe's Disease, Hunter's Disease, mucopolysaccharide storage disorder, gangliosidosis, alkaline hypophosphatasia, cholesterol ester storage disease, hyperuricemia, growth hormone deficiency, renal anemia and Maroteaux-Lary Disease.

In certain embodiments, the individual suffers from an orphan autoimmune condition. Such conditions include, but are not limited to, idiopathic thrombocytopenic purpura, membranous nephropathy, bullous pemphigoid, pemphigus vulgaris, and Myasthenia Gravis.

In certain embodiments, the individual suffers from a disorder associated with disease therapy. In the case of recombinant antibodies, tolerance is induced for example, to a humanized antibody being employed in a therapeutic context to prevent a patient from making neutralizing antibodies against the antibody therapeutic, e.g. tolerance to a humanized immune subset depleting antibody or anti-cytokine antibody being used as a treatment for autoimmune disease.

Autoimmune diseases can be divided in two broad categories: organ-specific and systemic. Autoimmune diseases include, without limitation, rheumatoid arthritis (RA), systemic lupus erythematosus (SLE), type I diabetes mellitus, type II diabetes mellitus, multiple sclerosis (MS), immune-mediated infertility such as premature ovarian failure, scleroderma, Sjogren's disease, vitiligo, alopecia (baldness), polyglandular failure, Grave's disease, hypothyroidism, polymyositis, pemphigus vulgaris, pemphigus foliaceus, inflammatory bowel disease including Crohn's disease and ulcerative colitis, autoimmune hepatitis including that associated with hepatitis B virus (HBV) and hepatitis C virus (HCV), hypopituitarism, graft-versus-host disease (GvHD), myocarditis, Addison's disease, autoimmune skin diseases, uveitis, pernicious anemia, Celiac disease, hypoparathyroidism neuomyelitis optica, membraneous nephropathy, bullous pemphigoid, pemphigus vulgaris, myasthenia gravis.

Autoimmune diseases may also include, without limitation, Hashimoto's thyroiditis, Type I and Type II autoimmune polyglandular syndromes, paraneoplastic pemphigus, bullus pemphigoid, dermatitis herpetiformis, linear IgA disease, epidermolysis bullosa acquisita, erythema nodosa, pemphigoid gestationis, cicatricial pemphigoid, mixed essential cryoglobulinemia, chronic bullous disease of childhood, hemolytic anemia, thrombocytopenic purpura, Goodpasture's syndrome, autoimmune neutropenia, myasthenia gravis, Eaton-Lambert myasthenic syndrome, stiff-man syndrome, acute disseminated encephalomyelitis, Guillain-Barre syndrome, chronic inflammatory demyelinating polyradiculoneuropathy, multifocal motor neuropathy with conduction block, chronic neuropathy with monoclonal gammopathy, opsonoclonus-myoclonus syndrome, cerebellar degeneration, encephalomyelitis, retinopathy, primary biliary sclerosis, sclerosing cholangitis, gluten-sensitive enteropathy, ankylosing spondylitis, reactive arthritides, polymyositis/dermatomyositis, mixed connective tissue disease, Bechet's syndrome, psoriasis, polyarteritis nodosa, allergic angiitis and granulomatosis (Churg-Strauss disease), polyangiitis overlap syndrome, hypersensitivity vasculitis, Wegener's granulomatosis, temporal arteritis, Takayasu's arteritis, Kawasaki's disease, isolated vasculitis of the central nervous system, thromboangiitis obliterans, sarcoidosis, glomerulonephritis, and cryopathies. These conditions are well known in the medical arts and are described, for example, in Harrison's Principles of Internal Medicine, 14th ed., Fauci A S et al., eds., New York: McGraw-Hill, 1998.

Animal models for the study of autoimmune disease are known in the art. For example, animal models which appear most similar to human autoimmune disease include animal strains which spontaneously develop a high incidence of the particular disease. Examples of such models include, but are not limited to, the nonobese diabetic (NOD) mouse, which develops a disease similar to type 1 diabetes, and lupus-like disease prone animals, such as New Zealand hybrid, MRL-Fas'p' and BXSB mice. Animal models in which an autoimmune disease has been induced include, but are not limited to, experimental autoimmune encephalomyelitis (EAE), which is a model for multiple sclerosis, collagen-induced arthritis (CIA), which is a model for rheumatoid arthritis, Desmoglein 3 transgenic T cell mouse, which can be used as an experimental model of pemphigus vulgaris and experimental autoimmune uveitis (EAU), which is a model for uveitis. Animal models for autoimmune disease have also been created by genetic manipulation and include, for example, IL-2/IL-10 knockout mice for inflammatory bowel disease, Fas or Fas ligand knockout for SLE, and IL-I receptor antagonist knockout for rheumatoid arthritis.

In certain embodiments, the individual suffers from a bacterial or viral infection. An individual having a bacterial or viral infection is an individual with a recognizable symptom of an existing bacterial or viral infection.

A non-limiting list of viral infections treatable with the modified particles of the current invention includes herpes virus infections, hepatitis virus infections, west nile virus infections, flavivirus infections, influenza virus infections, rhinovirus infections, papillomavirus infections, paromyxovirus infections, parainfluenza virus infections, and retrovirus infections. Preferred viruses are those viruses that infect the central nervous system of the subject. Most preferred viruses are those that cause hemorragic fever, encephalitis or meningitis.

A non-limiting list of bacterial infections treatable with the modified particles of the current invention include *Staphylococcus* infections, *Streptococcus* infections, mycobacterial infections, *Bacillus* infections, *Salmonella* infections, *Vibrio* infections, spirochete infections, and *Neisseria* infections. Preferred are bacteria that infect the central nervous system of the subject. Most preferred are bacteria that cause encephalitis or meningitis.

In some embodiments, the invention relates to uses of compositions of this invention prior to the onset of disease. In other embodiments, the invention relates to uses of the compositions of this invention to inhibit ongoing disease. In some embodiments, the invention relates to ameliorating disease in a subject. By ameliorating disease in a subject is meant to include treating, preventing or suppressing the disease in the subject.

In some embodiments, the invention relates to preventing the relapse of disease. For example, an unwanted immune response can occur at one region of a peptide (such as an antigenic determinant). Relapse of a disease associated with an unwanted immune response can occur by having an immune response attack at a different region of the peptide. Since the immune modifying particles of the current invention are free from attached peptides or antigenic moieties, the particles will be effective against multiple epitopes. T-cell responses in some immune response disorders, including MS and other ThI/17-mediated autoimmune diseases, can be dynamic and evolve during the course of relapsing-remitting and/or chronic-progressive disease. The dynamic nature of the T-cell repertoire has implications for treatment of certain diseases, since the target may change as the disease progresses. Previously, pre-existing knowledge of the pattern of responses was necessary to predict the progression of disease. The present invention provides compositions that can prevent the effect of dynamic changing disease, a function of "epitope spreading." A known model for relapse is an immune reaction to proteolipid protein (PLP) as a model for multiple sclerosis (MS). Initial immune response can occur by a response to PLP139-151. Subsequent disease onset can occur by a relapse immune response to PLP[pi]s-iβi.

Other embodiments of this invention relate to transplantation. This refers to the transfer of a tissue sample or graft from a donor individual to a recipient individual, and is frequently performed on human recipients who need the tissue in order to restore a physiological function provided by the tissue. Tissues that are transplanted include (but are not limited to) whole organs such as kidney, liver, heart, lung; organ components such as skin grafts and the cornea of the eye; and cell suspensions such as bone marrow cells and cultures of cells selected and expanded from bone marrow or circulating blood, and whole blood transfusions.

A serious potential complication of any transplantation ensues from antigenic differences between the host recipient and the engrafted tissue. Depending on the nature and degree of the difference, there may be a risk of an immunological assault of the graft by the host, or of the host by the graft, or both, may occur. The extent of the risk is determined by following the response pattern in a population of similarly treated subjects with a similar phenotype, and correlating the various possible contributing factors according to well accepted clinical procedures. The immunological assault may be the result of a preexisting immunological response (such as preformed antibody), or one that is initiated about the time of transplantation (such as the generation of Th cells). Antibody, Th cells, or Tc cells may be involved in any combination with each other and with various effector molecules and cells. However, the antigens which are involved in the immune response are generally not known, therefore posing difficulties in designing antigen-specific therapies or inducing antigen-specific tolerance.

Certain embodiments of the invention relate to decreasing the risk of host versus graft disease, leading to rejection of the tissue graft by the recipient. The treatment may be performed to prevent or reduce the effect of a hyperacute, acute, or chronic rejection response. Treatment is preferentially initiated sufficiently far in advance of the transplant so that tolerance will be in place when the graft is installed; but where this is not possible, treatment can be initiated simultaneously with or following the transplant. Regardless of the time of initiation, treatment will generally continue at regular intervals for at least the first month following transplant. Follow-up doses may not be required if a sufficient accommodation of the graft occurs, but can be resumed if there is any evidence of rejection or inflammation of the graft. Of course, the tolerization procedures of this invention may be combined with other forms of immunosuppression to achieve an even lower level of risk.

Certain embodiments of the invention relate to decreasing or otherwise ameliorating the inflammatory response induced as a response to surgery. In one embodiment of the invention, the immune-modifying particles are administered before surgery. In a further embodiment of the invention, the immune-modifying particles are administered concurrently with or during surgery. In yet a further embodiment of the invention, the immune-modifying particles are administered after surgery.

The particles of the invention may also be used to treat abscesses or empyemas to decrease the inflammatory response produced in the subject after exposure to infectious agents such as bacteria or parasites. In one embodiment of the invention, the immune-modifying particles are administered in conjunction with anti-bacterial and/or anti-parasitic treatments known in the art.

The particles of the invention may also be used to decrease or otherwise ameliorate the inflammatory response induced as a response to physical trauma or injury including, but not limited to, a sports injury, a wound, a spinal cord injury, a brain injury, and/or a soft tissue injury. In one embodiment of the invention, the immune-modifying particles are administered after the subject experiences trauma or injury.

The particles of the invention may also be used to decrease the inflammatory response associated with the development and/or growth of cancer cells. Cancers that can be treated include, but are not limited to, central nervous system cancer, basal cell carcinoma, cancerous brain tumors, Burkitt's lymphoma, lymphoma, cervical cancer, ovarian cancer, testicular cancer, liver cancer, non-small cell and small cell lung cancers, melanoma, bladder cancer, breast cancer, colon and rectal cancers, endometrial cancer, kidney (renal cell) cancer, leukemia, Non-Hodgkin lymphoma, pancreatic cancer, prostate cancer, melanoma, and thyroid cancer. In one embodiment, the subcutaneous injection of the particles of the invention prevents the accumulation of inhibitory neutrophils, thereby decreasing inflammation in the cancer patient.

The particles of the invention are also useful for the regeneration of damaged tissue. In one embodiment, administration of the particles to a patient increases the regeneration of damaged epithelial cells in the digestive tract. In a further embodiment, the patient suffers from colitis, Crohn's disease, or inflammatory bowel disease. In another embodiment, administration of the particles of the invention to a patient increases remyelination of neurons. In a further embodiment, the patient suffers from multiple sclerosis.

Scaffolds, Matrices, and Delivery Systems

In some embodiments, compositions of the present invention (e.g., PLG carrier polymer covalently coupled to antigenic molecule) find use with one or more scaffolds, matrices, and/or delivery systems (See, e.g., U.S. Pat. App. 2009/0238879; U.S. Pat. Nos. 7,846,466; 7,427,602; 7,029,697; 6,890,556; 6,797,738; 6,281,256; herein incorporated by reference in their entireties). In some embodiments, particles (e.g., antigen-coupled PLG particles) are associated with, adsorbed on, embedded within, conjugated to, etc. a scaffold, matrix, and/or delivery system (e.g., for delivery of chemical/biological material, cells, tissue, and/or an organ to a subject). In some embodiments, a scaffold, matrix, and/or delivery system (e.g., for delivery of chemical/biological material, cells, tissue, and/or an organ to a subject) comprises and/or is made from materials described herein (e.g., PLG conjugated to one or more antigenic peptides).

In some embodiments, microporous scaffolds (e.g., for transplanting biological material (e.g., cells, tissue, etc.) into a subject) are provided. In some embodiments, microporous scaffolds are provided having thereon agents (e.g., extracellular matrix proteins, exendin-4) and biological material (e.g., pancreatic islet cells). In some embodiments, the scaffolds are used in the treatment of diseases (e.g., type 1 diabetes), and related methods (e.g., diagnostic methods, research methods, drug screening). In some embodiments, scaffolds are provided with the antigen-conjugated carriers described herein on and/or within the scaffold. In some embodiments, scaffolds are produced from antigen conjugated materials (e.g., antigen conjugated PLG).

In some embodiments, a scaffold and/or delivery system comprises one or more layers and/or has one or more chemical and/or biological entities/agents (e.g., proteins, peptide-conjugated particles, small molecules, cells, tissue, etc.), see, e.g., U.S. Pat. App. 2009/0238879; herein incorporated by reference in its entirety. In some embodiments, antigen-coupled particles are co-administered with a scaffold delivery system to elicit induction of immunological tolerance to the scaffold and the associated materials. In some embodiments, microporous scaffold is administered to a subject with particles described herein on or within the scaffold. In some embodiments, antigen-coupled particles coupled to a scaffold delivery system. In some embodiments, a scaffold delivery system comprises antigen-coupled particles.

Various modification, recombination, and variation of the described features and embodiments will be apparent to those skilled in the art without departing from the scope and spirit of the invention. Although specific embodiments have been described, it should be understood that the invention as claimed should not be unduly limited to such specific embodiments. Indeed, various modifications of the described modes and embodiments that are obvious to those skilled in the relevant fields are intended to be within the scope of the following claims. For example, U.S. Pat. Applications 2012/0076831, 2002/0045672, 2005/0090008, 2006/0002978, and 2009/0238879 (each of which is herein incorporated by reference in their entirety) and U.S. Pat. Nos. 7,846,466; 7,427,602; 7,029,697; 6,890,556; 6,797,738; and 6,281,256 (each of which is herein incorporated by reference in their entirety) provide details, modifications, and variations that find use in various embodiments described herein.

All publications and patents mentioned in the present application and/or listed below are herein incorporated by reference in their entireties.

EXAMPLES

The following examples are provided to further illustrate the advantages and features of the invention, but are not intended to limit the scope of this disclosure.

Materials and Methods

Microscope and Image Acquisition

Images were acquired on an Olympus BX-51 microscope (Olympus, Japan), using a DP-70 camera and DP manager 2.2.1 software (Olympus).

Isolation of Leukocytes from the Brain and Liver

As previously described (Getts et al, J Exp Med. 29: 2319, 2007) leukocytes were obtained from the brains of PBS-perfused mice by digesting brains for 60 minutes at 37° C. in PBS with deoxy-ribonuclease (0.005 g/ml; Sigma Aldrich) and collagenase IV (0.05 g/ml; Sigma Aldrich). Digestion was stopped with 10% FCS, and the homogenate was passed through a 70 μm nylon cell strainer (Becton Dickinson, NJ, USA). The pellet, obtained after 10 minutes centrifugation at 340×g, was resuspended in 30% Percoll (Amersham, Norway) and layered over 80% Percoll. Leukocytes were collected from the 30%/80% interface after centrifugation at 1140×g for 25 minutes at room temperature. The same protocol is also used to derive leukocytes from the liver, with the tissue weighed before processing.

Isolation of Leukocytes from the Spleen, Blood and Bone Marrow

For flow cytometric analysis, the right femur was dissected out and bone marrow cells flushed out using PBS loaded syringes. For bone marrow precursor isolation, femurs and tibias from at least 4 mice were utilized. The cellular suspension achieved after flushing was filtered through a 70 μm cell strainer and centrifuged for 5 mins at 340 g. Red blood cells in the resulting pellet were lysed in NH4Cl-based red cell lysis buffer (BD Pharm Lyse™; BD Pharmingen), before centrifugation for 5 mins at 340×g. In the case of peripheral blood, blood was collected via cardiac puncture and immediately transferred into citrate buffer (mMol, Sigma Aldrich). The resulting suspension was layered over 70% Percoll and centrifuged at 1140×g for 20 minutes at room temperature with the brake off. The interface was collected and the cells washed once in PBS, centrifuged at 340×g. For the isolation of splenic leukocytes, spleens were passed through a 7070 μm cell strainer and centrifuged for 5 mins at 340 g. Red blood cells in the resulting pellet were lysed in NH4Cl-based red cell lysis buffer (BD Pharm Lyse™; BD Pharmingen), before centrifugation for 5 mins at 340×g.

Flow Cytometry

Cells collected (as described above) from the brain, liver, blood, and bone marrow were washed in PBS, and blocked with anti-CD16/CD32 antibody (Biolegend). Viable cells were counted using trypan blue exclusion, which routinely showed >95% cell viability.

Cell surface molecule expression was measured and cell sorts carried out on a FACS ARIA (Becton Dickinson), equipped with an Argon ion and HeNe laser. Viable populations were gated by forward and side scatter and identified fluorescent populations determined by forward-gating thereafter. Sorting was carried out using specific fluorescent and scatter parameters identifying the population of interest. Sorting stringencies was set to purity to achieve >98% purity for bone marrow populations.

Acquired FACS data files were analysed using the flow cytometry program, Flow Jo (FlowJo, Ashland, OR, USA). Quantification of cell populations of interest were calculated based on flow cytometry percentages at analysis and absolute cell counts from each organ.

Induction and Evaluation of Experimental Autoimmune Encephalitis (EAE)

Mice were injected sub-cutaneously with emulsion containing 0.1 mg MOG Peptide (MEVGWYRSPFSRVVH-LYRNGK (SEQ ID NO:1); Auspep, Parkville, Victoria, Australia; >95% HPLC purified) and Complete Freund's adjuvant containing 2 mg/mL *Mycobacterium tuberculosis* (Sigma Aldrich). Two days later, mice were administered 500 □l Pertussis toxin (Sigma Aldrich) i.p. Mice were monitored for disease progression, and graded on the following scale: 1, limp tail and/or weakness of 1 hind limb; 2, weakness in more than one limb, gait disturbance; 3, paralysis in 1 limb; 4, paralysis in more than one limb, incontinence; 5, moribund.

Statistics

Graphs were made and computerized statistical analysis was performed in GraphPad Prism, and InStat, respectively (both programs from GraphPad software, San Diego, CA, USA). Depending on the data, an unpaired, two-tailed Student t-test, or one way ANOVA with a Tukey-Kramer post-test was performed, with P<0.05 considered to be significant.

For correlation analysis between parameters such as weight loss, infiltration, and virus titre, a non-linear regression (curve fit) was used, with a second order polynomial ($Y=A+B*X+C*X^2$).

Example 1

Figure 1:
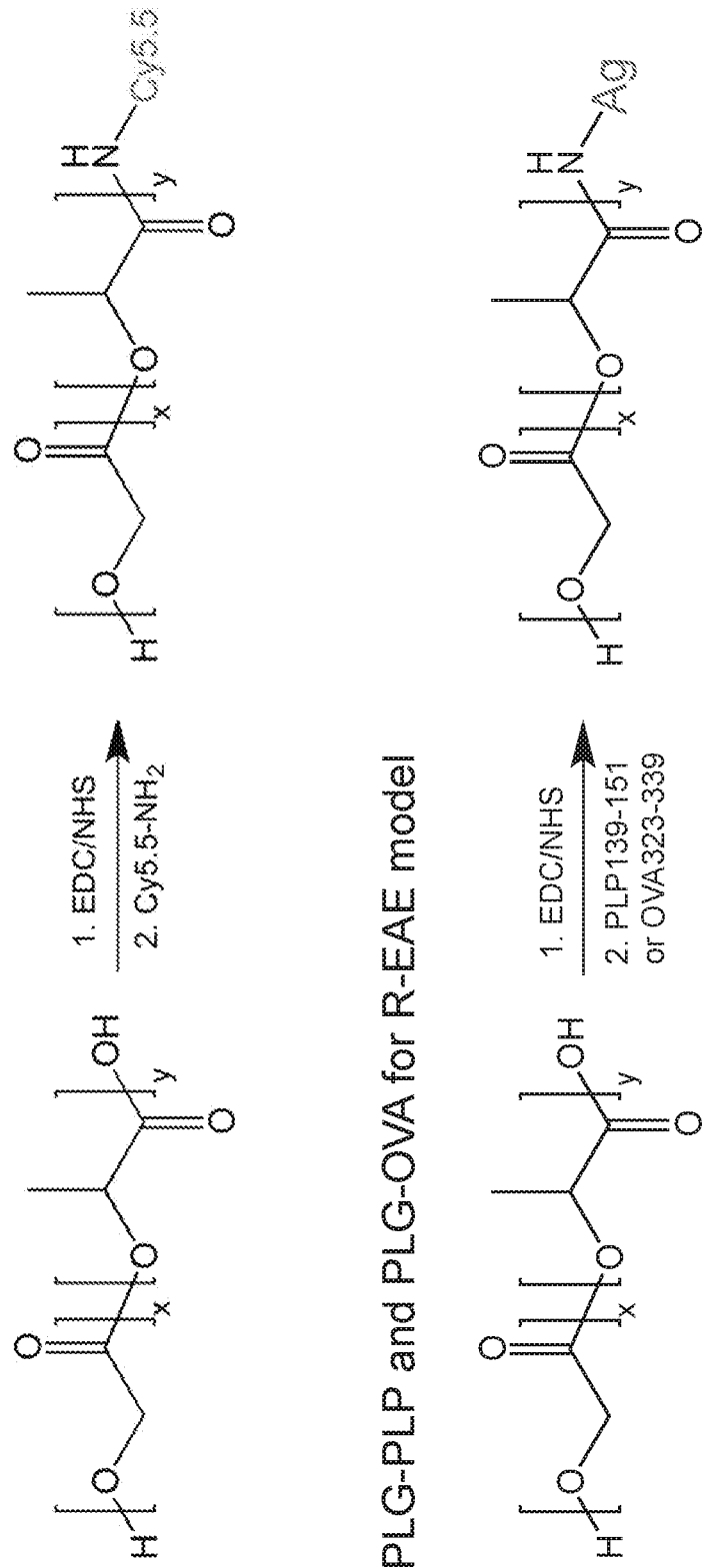

Synthesis and Characterization of PLG-Peptide Conjugates and Nanoparticle Formation Poly(lactide-co-glycolic acid) (PLG) was covalently linked to either Cy5.5 fluorescent dye or antigen with the coupling reagent 1-Ethyl-3-(3-dimethylaminopropyl)carbodiimide (EDC)/N-hydroxysuccinimide (NHS). The antigen was either proteolipid protein (PLP139-151) or ovalbumin (OVA323-339) (FIG. 1).

Particles with various sizes were prepared by the double emulsion and nanoprecipitation methods. The size and zeta potential of the nanoparticle formulations were determined and are provided above in Table 1.

Figures 2B, 2C:
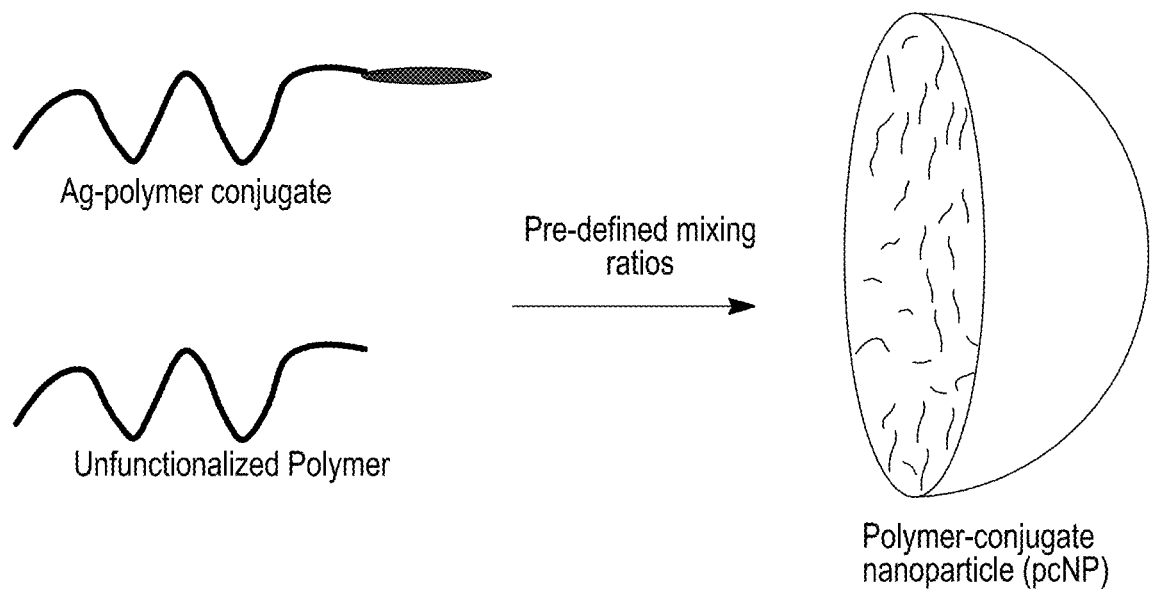

The coupling efficiency of antigen to PLG was analysed by $^1$H-NMR. FIG. 2 shows the $^1$H-NMR spectrum of (i) PLG, (ii) OVA323-339, and (iii) PLG-OVA323-339 measured in DMSO-d6 (calibrated at 2.5 ppm). The coupling efficiency of OVA323-339 to PLG was calculated by comparing the integration values of the overlapping methyl proton peaks of leucine and isoleucine present at 1.4 ppm in OVA323-339 (d, d') to the methylene proton peak present at 5.3 ppm in PLG (b). A schematic representation of the polymer-conjugate nanoparticles is provided in FIG. 2C.

By changing the chemistry, the coupling efficiency of PLP to PLG can be increased to about 20%.

Loading (μg antigen (Ag)/mg PLG) was precisely controlled by combining PLG-Ag conjugates with unconjugated PLG at predetermined mixing ratios (see Table 1 above).

Example 2

Size and Time-Dependent Cellular Interactions of PLG Nanoparticles

Figure 3:
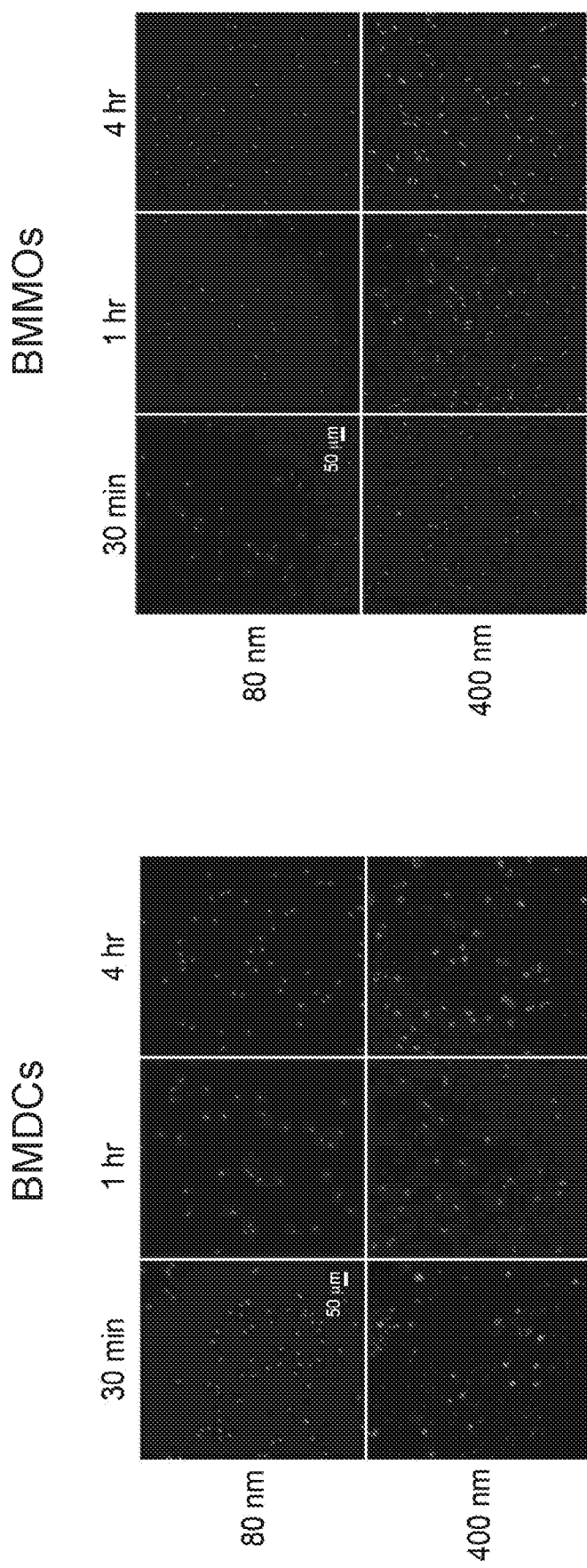

Eighty nm and 400 nm PLG nanoparticles were fluorescently labeled with 1% (by wt.) PLG-Cy5.5 conjugate and incubated with bone marrow-derived dendritic cells (BMDCs) or bone marrow-derived macrophages (BMMOs) up to 4 hr at 37° C. (FIG. 3). The blue fluorescence indicates DAPI staining of nuclei and the red fluorescence indicates PLG-Cy5.5 nanoparticles.

Example 3

BMDC Surface Marker Characterization after Treatment with PLG-OVA Particles Having Various Antigen Loadings BMDCs were treated for 3 hr with 300 μg/mL of 400 nm and 80 nm PLG-OVA nanoparticle formulations with various antigen-loadings. Non-internalized PLG-OVA nanoparticles were subsequently washed from the cell surface. The cell surface markers MHCII, CD80 and CD86 were assayed using flow cytometry after 4 days of incubation. FIG. 4A and FIG. 4D show MHCII marker expression following treatment with 400 nm and 80 nm particles, respectively. FIG. 4B and FIG. 4E show CD80 marker expression following treatment with 400 nm and 80 nm particles, respectively. FIG. 4C and FIG. 4F show CD86 marker expression following treatment with 400 nm and 80 nm particles, respectively. Treatment of cells with PLG-OVA nanoparticles, regardless of antigen content, resulted in significantly down-regulated MHCII and CD80 expression.

Example 4

Antigen-Specific Induction of Regulatory T Cells by PLG-OVA Particles Delivered to Antigen Presenting Cells (APCs)

Figure 5:
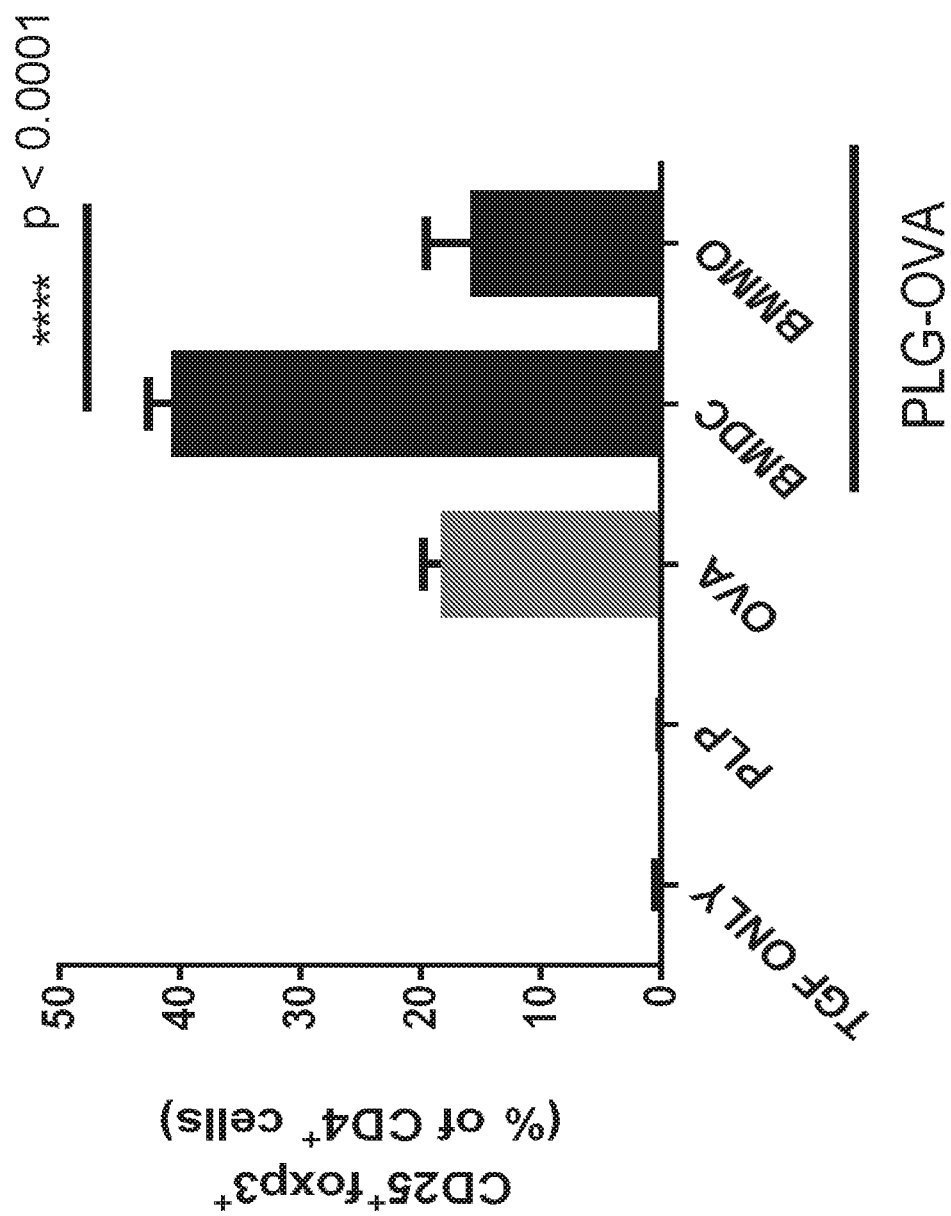
FIG. 5 shows antigen-specific induction of regulatory T cells by PLG-OVA323-339 particles delivered to antigen presenting cells (APCs). The difference in induction in BMDC versus BMMO cells was significant, at $p<0.0001$.

BMDCs or BMMOs were treated for 3 hr with 300 µg/mL of 400 nm PLG-OVA nanoparticle formulations with 8 µg/mg PLG antigen loading. Non-internalized PLG-OVA nanoparticles were subsequently washed from the cell surface prior to addition of OT-II T cells and 2 ng/mL of TGF-β1. The cells were co-cultured for 4 days prior to using flow cytometry to measure CD25 activation and foxp3 expression of T cells as indication of induction of regulatory T cells. The difference in induction in BMDC versus BMMO was significant, at $p<0.0001$ (FIG. 5).

Example 5

Figure 6:
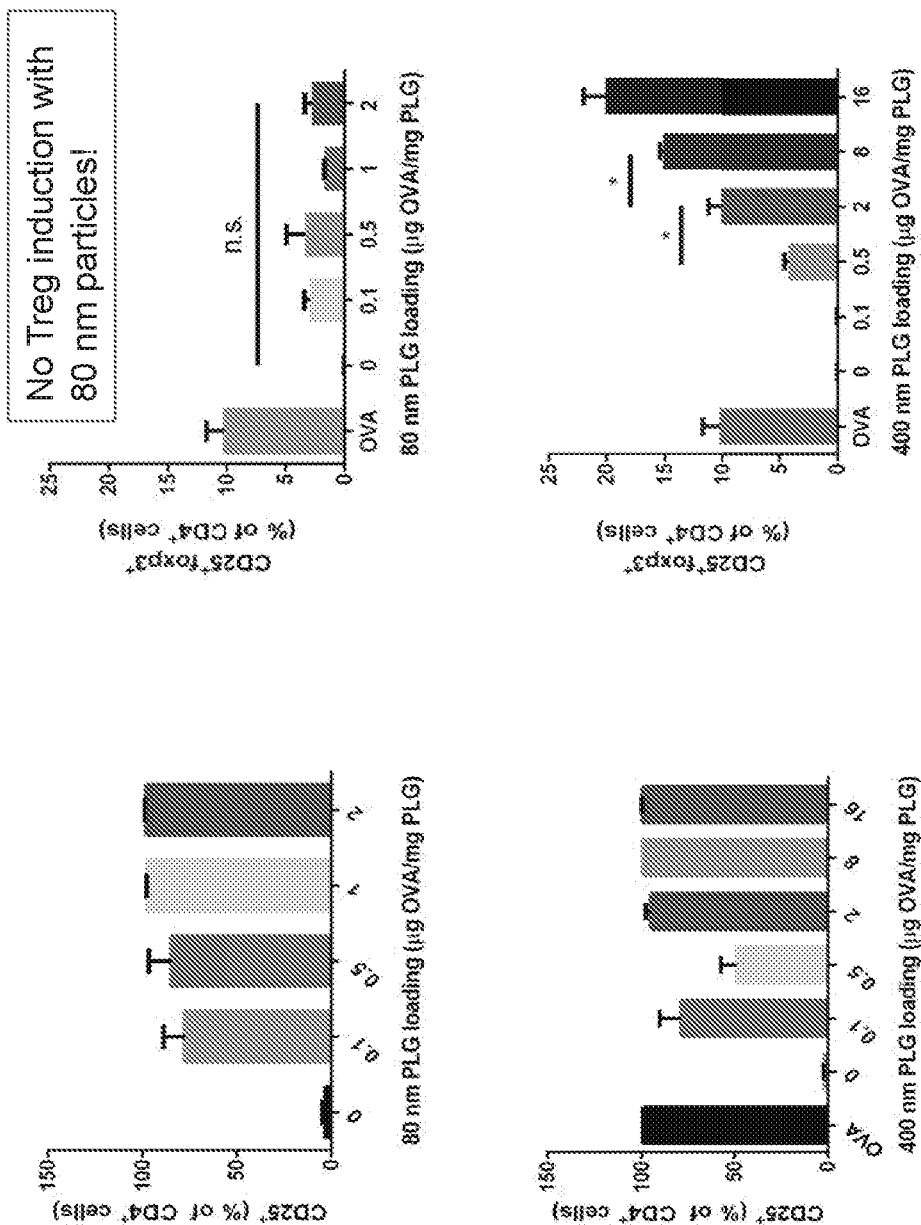
FIG. 6 shows size- and antigen-loading-dependent CD25 activation and induction of regulatory T cells by PLG-OVA323-339 particles. * indicates significance at $p<0.05$.

Size- and Antigen-Loading-Dependent CD25 Activation and Induction of Regulatory T Cells by PLG-OVA Particles Bone marrow-derived dendritic cells (BMDCs) were treated for 3 hr with 300 µg/mL of 400 nm and 80 nm PLG-OVA nanoparticle formulation. Non-internalized PLG-OVA nanoparticles were subsequently washed from the cell surface prior to addition of OT-II T cells and 2 ng/mL of TGF-β1. The cells were co-cultured for 4 days prior to using flow cytometry to measure CD25 activation and foxp3 expression of T cells. Although both nanoparticle formulations were able to increase CD25 activation similarly, only 400 nm PLG-OVA nanoparticles could successfully induce regulatory T cells (FIG. 6).

Example 6

Figure 7A:
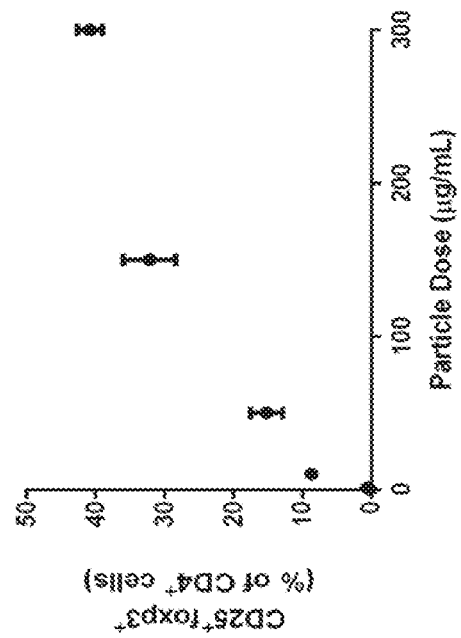
FIG. 7A-7B shows induction of regulatory T cells indicated by (FIG. 7A) CD25 activation and by (FIG. 7B) foxp3 expression as a function of PLG-OVA323-339 particle dose.
Figure 7B:
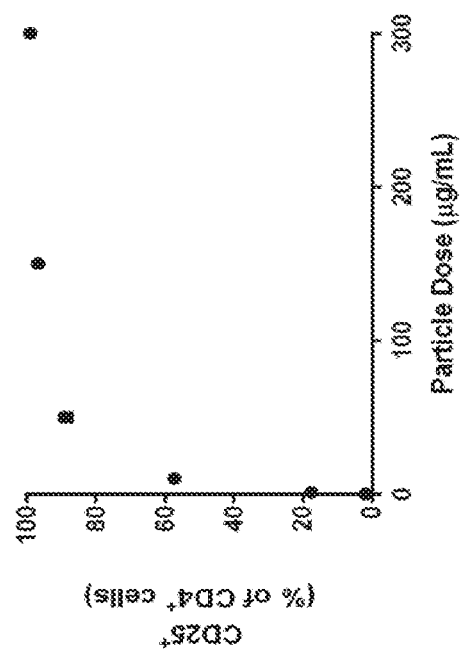

CD25 Activation and Induction of Regulatory T Cells as a Function of PLG-OVA Particle Dose Regulatory T cell induction is dependent on nanoparticle dose. Bone marrow-derived dendritic cells (BMDCs) were treated for 3 hr with various concentrations of 400 nm of PLG-OVA nanoparticles (8 µg/mg loading) formulation. Non-internalized PLG-OVA nanoparticles were subsequently washed from the cell surface prior to addition of OT-II T cells and 2 ng/mL of TGF-β1. The cells were co-cultured for 4 days prior to using flow cytometry to measure CD25 activation (FIG. 7A) and foxp3 expression (FIG. 7B) of T cells. Although CD25 activation reached a maximum at 50 µg/mL, foxp3 expression appeared to plateau at 300 mg/mL.

Example 7

Size- and Concentration-Dependent Biodistribution of PLG Particles

Mice were injected either intravenously (IV) or subcutaneously (SC) with 1.25 mg of 400 nm or 80 nm PLG-Cy5.5 nanoparticle formulation. Cells from the liver, kidney, heart, lung, spleen and inguinal lymph nodes were isolated. Data was analyzed by flow cytometry 24 hr after injection. The liver is the primary site of particle accumulation (FIG. 8A).

The proportion of cells that were CD45+ versus CD45− was determined for liver, spleen and lung (FIG. 8B).

Mice were injected intravenously with 1.25 mg of PLG-Cy5.5 nanoparticle formulations of various particle sizes. Data was analyzed by flow cytometry 24 hr after injection. The proportion of Cy5.5+ cells found in the liver, spleen and lung was determined for a given particle size (FIG. 8C). The vast majority of 400 nm and 200 nm PLG-Cy5.5 nanoparticles were found in the liver. About 50% of CD45+ cells contained 80 nm and 200 nm PLG-Cy5.5 nanoparticles, whereas only about 5% to about 10% of CD45− cells contained 80 nm and 200 nm PLG-Cy5.5 nanoparticles, respectively. By contrast, about 75-80% of both CD45+ and CD45− cells contained 400 nm PLG-Cy5.5 nanoparticles (FIG. 8D). Injection of either 0.625 mg or 1.25 mg of 400 nm PLG-Cy5.5 nanoparticles leads to accumulation of about 100% of the particles in both CD45+ and CD45− cells (FIG. 8E).

Example 8

PLG Particles are Associated with Neutrophils and Monocytes in the Blood

Healthy mice (n=3) were injected intravenously with 1.25 mg of 400 nm or 80 nm PLG-Cy5.5 nanoparticle formulation. Blood was collected and analyzed by flow cytometry 2 hr after injection. Expression of CD11 b, CD11c, Gr-1 and Ly6c markers were used to identify the types of leukocytes. Cy5.5 fluorescence was used to determine which cells had 80 nm and 400 nm PLG-Cy5.5 nanoparticles. PLG-Cy5.5 particles are associated with neutrophils and monocytes in the blood (FIG. 9).

Example 9

PLG Particles Induce Regulatory T Cells Ex Vivo and Induce Tolerance in Experimental Autoimmune Encephalitis (EAE)

BMDCs, splenic dendritic cells or liver dendritic cells were treated for 3 hr with 300 µg/mL of either OVA alone or 400 nm PLG-OVA nanoparticle formulations (8 µg/mg PLG antigen loading). Non-internalized PLG-OVA nanoparticles were subsequently washed from the cell surface prior to addition of OT-II T cells and 2 ng/mL of TGF-β1. The cells were co-cultured for 4 days prior to using flow cytometry to measure CD25 activation and foxp3 expression of T cells as indication of induction of regulatory T cells.

Liver and splenic dendritic cells were activated with just OVA alone, whereas activation of BMDCs was not significantly different between treatment with OVA versus PLG-OVA (FIG. 10A).

Mice were injected intravenously with 1.25 mg of PLG-Cy5.5 nanoparticle formulations. Data was analyzed by flow cytometry 24 hr after injection. Cells in the spleen exhibiting Cy5.5 fluorescence had the highest level of CD25 activation and foxp3 expression, indicative of regulatory T cell induction (FIG. 10B).

PLG nanoparticles were investigated with the immunodominant proteolipid protein PLP139-151 epitope (PLG-PLP139-151) to induce tolerance for prevention of Relapsing Experimental Autoimmune Encephalitis (R-EAE). The R-EAE mice were generated as described above.

The peptides administered to the animals were covalently coupled to particles. Mice were treated with either PLP139-151-PLG (N=3-7) or PBS buffer on day −7 relative to the time of immunization (day 0). Peak disease was typically observed around day 12 to 14, and mice were scored for clinical disease. PBS buffer only did not prevent disease induction. However, PLG particles covalently coupled with PLP139-151 produced a clinical score of 0 (no disease) at all except low clinical scores of under 1 exhibited between days 20 and 30 (FIG. 10C). The cumulative disease scores as measured from 0-30 days post immunization clearly show that treatment of mice with nanoparticle formulations resulted in significantly abrogated clinical disease scores compared to controls (FIG. 10D).

Example 10

Figures 11B, 11C:
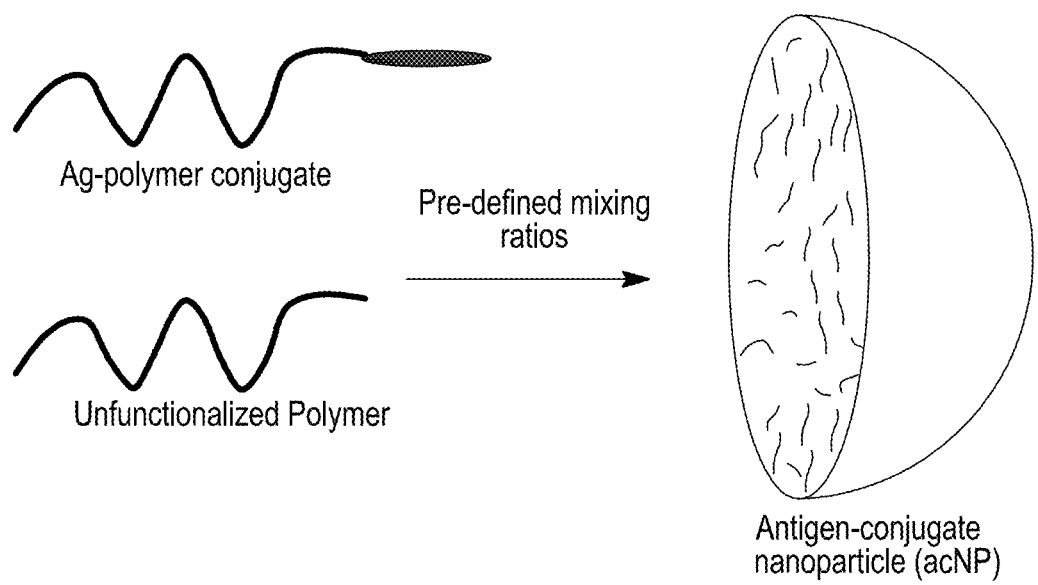
Figure 11D:
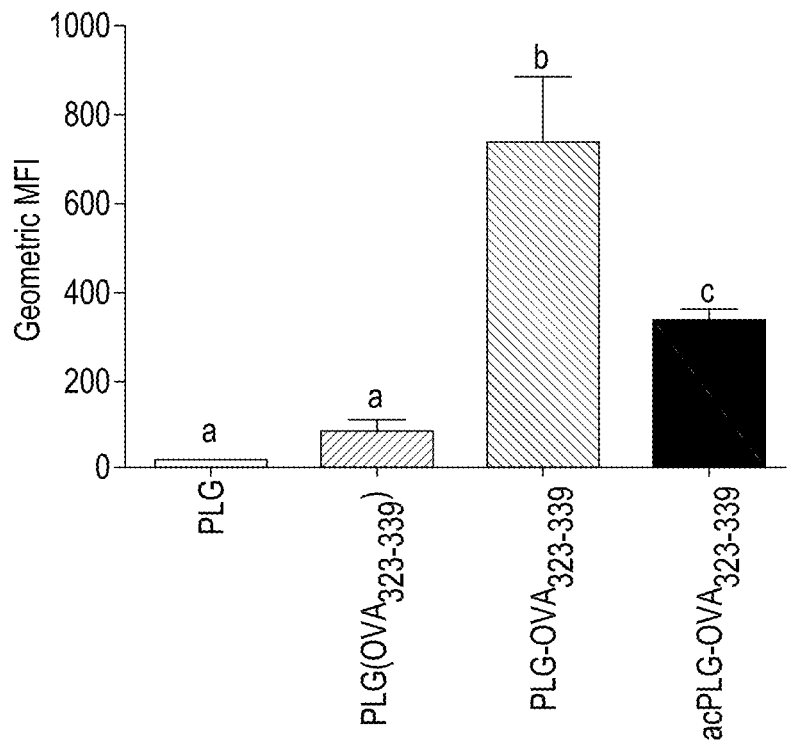
Figure 11E:
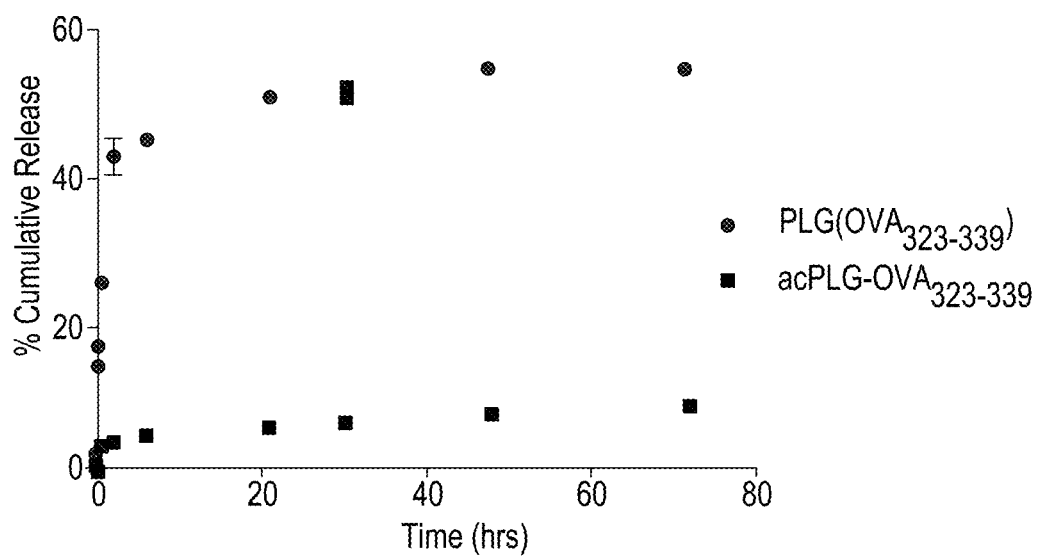
Figure 12A:
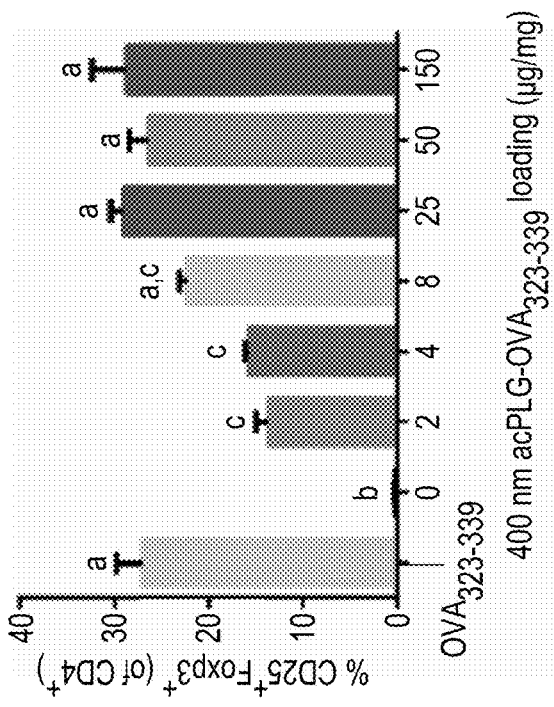
Figure 12C:
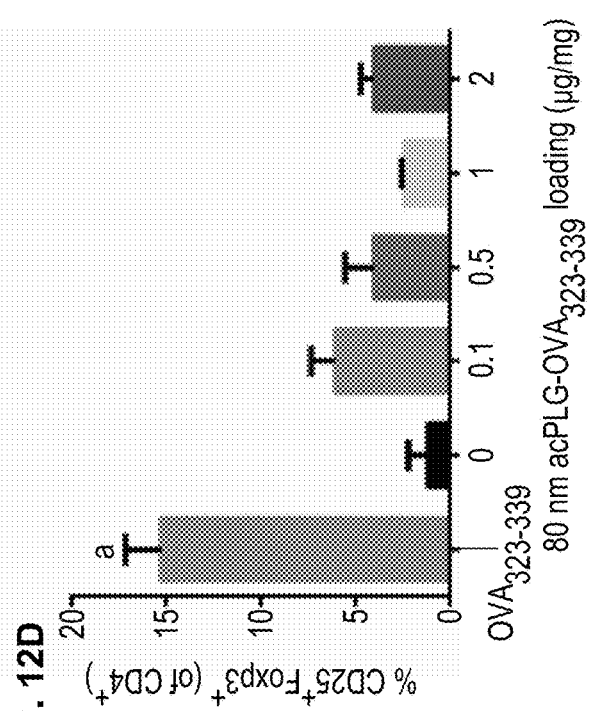
Figure 12B:
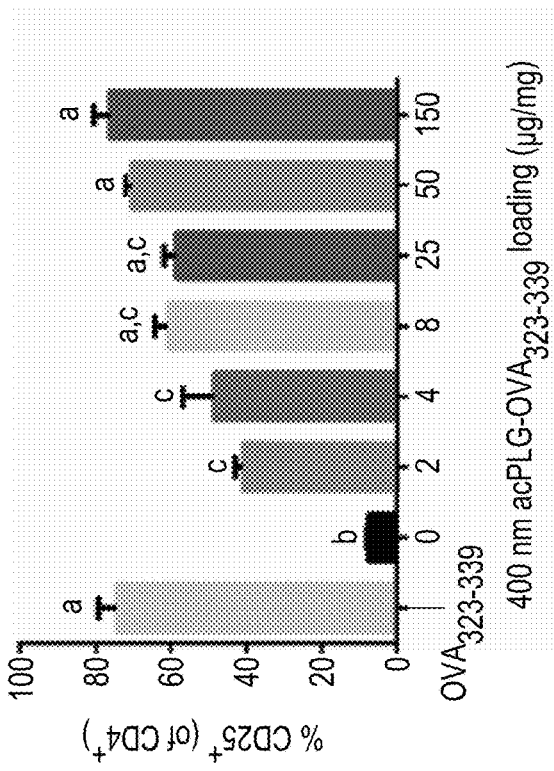
Figure 12D:
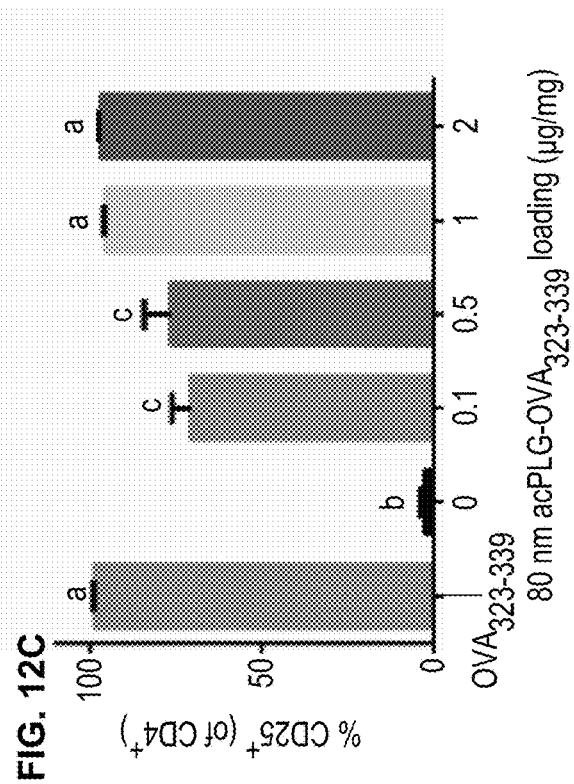

Controlled Delivery of Single or Multiple Antigens in Tolerogenic Nanoparticles Using Peptide-Polymer Bioconjugates
Synthesis of Antigen-Polymer Bioconjugates and Particle Preparation Encephalitogenic proteolipid peptides (PLP139-151 or PLP178-191) and ovalbumin peptide (OVA323-339) were conjugated to the terminal carboxylic acid group of PLG (4200 g/mol; 0.17 dL/g) using carbodiimide chemistry (FIG. 11A. FIG. 19, and FIG. 20). Coupling efficiencies were determined by $^1$H-NMR characterization to be 73.6%, 74.1%, and 66.9%, respectively (FIG. 11B). Two sizes (400 nm and 80 nm) of acPLG-Ag particles (antigen-conjugated PLG-Ag particles) were prepared using the solvent evaporation emulsion method (S.E) and nanoprecipitation method, respectively. Ag loadings were controlled by admixing Ag-PLG bioconjugates with unmodified PLG at various ratios (FIG. 11C). Given these coupling efficiencies, a maximum Ag loading (μg of Ag per mg of particle) of 211 μg/mg (266 μg/mg theoretical), 218 μg/mg (274 μg/mg theoretical), and 220 μg/mg (297 μg/mg theoretical) is possible to be achieved for acPLG-PLP139-151, acPLG-PLP178-191, and acPLG-OVA323-339, respectively. The size of the acPLG-Ag particles prepared by the S.E. method was minimally affected by varying the Ag loading to 25 μg/mg, but increased slightly with antigen loadings of 50 μg/mg and higher (Table 4). However, surface coupling of Ag to PLG particles led to significantly increased size and polydispersity. The sizes for particles prepared by nanoprecipitation trended upwards depending on Ag loading and a maximum loading of only 2 μg/mg could be achieved. The zeta potential was not impacted by the Ag loading and was highly negative for all acPLG particles (between −30 to −56 mV). These experiments confirmed that acPLG particles could be prepared with controllable Ag loadings through systematic combination of PLG-Ag bioconjugates with unmodified PLG with well-controlled physicochemical properties.

acPLG particles were compared to Ag-coupled PLG particles (PLG-Ag), and Ag-encapsulated PLG particles (PLG (Ag)) for Ag-specific antibody binding to their surface using a fluorescence-tagged OVA323-339-IgG1. Encapsulation of Ag into particles (PLG(Ag)) has been demonstrated to reduce the potential for antibody binding to particle that could result in immune activation in vivo. Binding to the surface of the three particle variations demonstrated significantly less binding of IgG1 to acPLG-OVA323-339 (8 μg/mg) than PLG-OVA323-339 particles (7.5 μg/mg) (FIG. 1D). Ag-encapsulated PLG(OVA323-339) bound the least amount of IgG1, however a maximal antigen loading of only 3 μg/mg was achievable. The decreased IgG1 binding is suspected to result from the significantly lower Ag loading and burst release of Ag, that was similarly observed for other PLG particles Importantly, acPLG particles did not display any significant burst release of Ag compared to PLG(Ag) particles (FIG. 11E).
Regulatory T Cell Induction by acPLG-Ag Particles is Size and Ag Loading-Dependent The ability of acPLG-Ag particles to promote antigen presentation by dendritic cells and subsequently influence the activation of naïve CD4$^+$CD25$^-$ T cells and induce the formation of regulatory T cells (Tregs) was next investigated in vitro as a function of particle size and Ag loading. Treg induction was used to determine tolerogenic effects of acPLG particles because they have been shown to mediate immune tolerance in vivo. Delivery of both 80 and 400 nm acPLG-OVA323-339 particles to bone-marrow derived dendritic cells (BMDCs) followed by co-culture with Ag-specific naïve OTII CD4$^+$CD25$^-$ T cells in the presence of TGFβ resulted in upregulation of CD25 on T cells, even at the lowest Ag loading conditions tested (FIGS. 12A and 12B). Although CD25 expression was increased by both acPLG-OVA323-339 particle sizes, it did not correlate with Treg induction as measured by CD25 and Foxp3 expression. Tregs were induced at high levels only with the 400 nm acPLG-OVA323-339 particles, and was dependent on Ag loading (FIG. 12C). At a NP concentration of 300 μg/mL, maximal Treg induction was observed at an Ag loading of 8 μg/mg and there was no significant difference observed by increasing the loading to 150 μg/mg. acPLG-OVA323-339 particles with a diameter of 80 nm, regardless of Ag loading, only induced low levels of Tregs (FIG. 12D). Taken together, the T cell expression of CD25 was particle size independent and induction of Tregs was particle size dependent. Importantly, we found that at high concentrations, acPLG-OVA323-339 particles up to 150 μg/mg loading were not significantly different than particles with 8 μg/mg loading for inducing Tregs in vitro.
Regulatory T Cell Induction by acPLG-Ag Nanoparticles is Particle Concentration-Dependent The concentration dependency of acPLG particles on the activation of naïve CD4$^+$CD25$^-$ T cells and induction of Tregs was tested using S.E. acPLG-OVA323-339 at multiple Ag loadings (2, 8, 25, 150 μg/mg) and particle concentrations (0, 5, 10, 75, 150, and 300 μg/mL). The range of Ag delivered to the BMDCs varied from 10 to 45,000 ng/mL (Table 4). A minimum of 1,200 ng/mL of Ag was required to achieve CD25 expression in greater than 40% of CD4 T cells. This level of expression was achieved even at low acPLG concentrations (5-10 μg/mL) with 150 μg/mg Ag loading (FIG. 13A). Similar CD25 expression was achieved using acPLG particles with 8 μg/mg Ag loading at a NP concentration of 150 μg/mL (1,200 ng/mL Ag delivered). CD25 expression over 60% of CD4 T cells occurred for an Ag concentration of 1,875 ng/mL or greater. Foxp3 expression on CD4$^+$CD25$^+$ T cells required a larger amount of Ag to reach the highest expression levels (over 30%). Treg induction correlated to levels of CD25 expression greater than 60% of CD4 T cells. Treg induction by acPLG-OVA323-339 particles was highly dependent on the total amount of Ag delivered per well. Additional Ag delivered over 1,875 ng/mL did not dramatically influence the percentage of Tregs detected in vitro (FIG. 13B). acPLG particles prepared with various Ag loadings enabled the Ag requirements to induce significant levels of Tregs in vitro to be determined and presents the possibility to utilize acPLG particles to modulate biological responses in vivo.

TABLE 4

Concentration of antigen delivered per well as a function of acPLG-OVA323-339 particle concentration and loading.

| Particle loading (μg/mg)/Concentration (μg/mg) | 0 | 5 | 10 | 75 | 150 | 300 |
|---|---|---|---|---|---|---|
| 0 | 0 | 0 | 0 | 0 | 0 | 0 |
| 2 | 0 | 10 | 20 | 150 | 300 | 600 |
| 4 | 0 | 20 | 40 | 300 | 600 | 1200 |
| 8 | 0 | 40 | 80 | 600 | 1200 | 2400 |

TABLE 4-continued

Concentration of antigen delivered per well as a function of acPLG-OVA323-339 particle concentration and loading.

| Particle loading (μg/mg)/Concentration (μg/mg) | 0 | 5 | 10 | 75 | 150 | 300 |
|---|---|---|---|---|---|---|
| 25  | 0 | 125 | 250  | 1875  | 3750  | 7500  |
| 50  | 0 | 250 | 500  | 3750  | 7500  | 15000 |
| *150* | 0 | 750 | 1500 | 11250 | 22500 | 45000 |

Bolded and italicized cells represent the protein loadings evaluated in FIG. 13.

acPLG-Ag Particles Suppress EAE Induced by PLP139-151 Immunization

The ability of acPLG-Ag particles to induce Ag-specific immune tolerance was tested using the R-EAE disease model of MS. While the in vitro data support particle internalization, Ag presentation, and Treg induction, the in vivo study is more challenging since the NPs must reach the appropriate cell types to elicit a tolerogenic response. In previous studies, Ag-encapsulated PLG(PLP139-151) particles were administered with Ag loading of approximately 2-3 μg/mg at a dose of 2.5 mg. Using a prophylactic disease model, acPLG-PLP139-151 particles were administered intravenously to SJL/J mice on day −7 relative to R-EAE immunization. Untreated control mice displayed severe clinical symptoms, whereas acPLG-PLP139-151 particle-treated mice displayed significantly reduced disease symptoms as measured by both the mean clinical score (FIG. 14A) and cumulative clinical score (FIG. 14B). Furthermore, the acPLG-PLP139-151 particles demonstrated similar effectiveness as Ag-encapsulated PLG(PLP139-151) particles given at a dose of 2.5 mg (FIGS. 14A-14B). These results confirmed that the higher Ag loading in acPLG particles could enable the dose of acPLG particles to be reduced with similar abilities to induce tolerance in vivo.

acPLG Particles Suppress EAE Induced with a Cocktail of Encephalitogenic Peptides (PLP139-151 and PLP178-191)

Diversity in the autoreactive T cell repertoire has been well established in autoimmune diseases such as MS; therefore, tolerogenic NPs will likely need to deliver multiple epitopes to effectively treat a disease whose pathogenesis can be complex. We tested if multiple myelin peptide-PLG bioconjugates, namely PLG-PLP139-151 and PLG-PLP178-191, could be incorporated into a single acPLG particle at precise Ag loadings and be used as an effective treatment for R-EAE induced by immunization with PLP139-151/PLP178-191/CFA (FIG. 15A).

acPLG particles were administered intravenously to SJL/J mice on day −7 relative to R-EAE immunization. Control mice, treated with acPLG-OVA323-339, acPLG-PLP139-151, or acPLG-PLP178-191 particles, displayed severe clinical disease symptoms compared to acPLG-PLP139-151,178-191 particles as measured by both the mean clinical score (FIG. 15B) and cumulative clinical score (FIG. 15C). Interestingly, the acute disease of mice treated with acPLG-PLP139-151 particles displayed a strong acute disease phase and a less severe relapse. This result was in contrast to mice treated with acPLG-PLP178-191 particles where a reduced acute disease was observed and a severe relapse occurred. Mice treated with acPLG-PLP139-151,178-191 displayed significantly reduced acute and relapse disease scores that resulted in a major diminishment in the measured cumulative scores. These results demonstrate the ability for acPLG particles to simultaneously tolerize against multiple peptides associated with the pathogenesis of disease. The modular design of acPLG particles incorporating various Ags using a PLG-Ag bioconjugate "mix-and-match" approach clearly demonstrates the versatility of the acPLG particle platform and design.

Soluble peptide, Ag-coupled cells, genetically engineered food products, and particles have been investigated as treatment options for applications including allergy, autoimmune disease, and cell transplantation. An advantage of the particles of the current invention (acPLG particles) over current nano-based tolerance platforms is that tolerance induction by acPLG particles is achieved without co-delivery of immunosuppressive agents that have been associated with many side effects. Differences in uptake mechanism and context of Ag presentation of acPLG particles may partially account for platforms such as soluble Ag arrays, tolerogenic nanoparticles (tNPs), and PEGylated gold nanoparticles requiring co-delivery of various immunomodulatory agents to induce tolerance. The results presented herein demonstrate a novel NP platform that achieves precise control over Ag delivery and tolerogenic responses in vivo. This controllable Ag delivery platform enabled the identification of the relationship between Ag loading, concentration, and size of acPLG particles with respect to the activation of T cells and induction of Tregs in vitro.

Materials and Methods

Poly(lactide-co-glycolide) (50:50) (PLG) with a single carboxylic acid end-group and an inherent viscosity of 0.17 dL/g in hexafluoro-2-propanol was purchased from Lactel Absorbable Polymers (Birmingham, AL). Poly(ethylene-alt-maleic anhydride) (PEMA) was purchased from Polyscience, Inc. (Warrington, PA). Amine-terminated ovalbumin peptide (NH2-OVA323-339) and proteolipid peptide (NH2-PLP139-151 or NH2-PLP178-191) was purchased from Genscript (Piscataway, NJ). All other reagents were purchased from Sigma Aldrich (St. Louis, MO) unless noted otherwise.

PLG-Ag Bioconjugation

PLG (37.8 mg, 0.009 mmol, 4200 g/mol) of was dissolved in 2 mL of N,N-dimethylformamide (DMF) in a 20 mL scintillation vial equipped with a stir bar. N-(3-Dimethylaminopropyl)-N'-ethylcarbodiimide hydrochloride (EDC) (9.0 mg, 0.047 mmol, 5× to PLG) was dissolved in 0.5 mL of DMF and added dropwise to the PLG solution. N-Hydroxysuccinimide (NHS) (5.5 mg, 0.047 mmol, 5× to PLG) was dissolved in 0.5 mL DMF and added dropwise to the solution. The reaction was allowed to stir for 15 minutes at room temperature. Antigenic peptide (1.2× to PLG) was dissolved in a solution of 1 mL dimethyl sulfoxide (DMSO) and 0.5 mL DMF and stirred at 400 RPM. Triethylamine (5× to peptide) was added to peptide solution and the mixture was added dropwise to the stirring PLG solution. The reaction was allowed to proceed overnight at room temperature. The resulting polymer was isolated and purified by dialysis using 3,500 molecular weight cut-off membrane against four liters of distilled water over two days. Distilled water was replaced a total of six times. The dialyzed polymer was collected and washed with MilliQ water three times MilliQ water by centrifugation at 7000×g before resuspension in 20 mL of water and lyophilization for two days. Coupling efficiency peptide to PLG was determined by NMR analysis in DMSO-d6.

Mice

Female SJL/J mice (6-8 weeks) were purchased from Harlan Laboratories (Indianapolis, IN). OT-II mice (B6.Cg- Tg(TcraTcrb)425Cbn/J) were purchased from Jackson Laboratory (Bar Harbor, ME).

Nanoparticle Preparation

Nanoparticles (acPLG) of two different sizes (80 and 400 nm) were prepared following either the nanoprecipitation or emulsion solvent evaporation method, respectively. To produce acPLG particles using the emulsion solvent evaporation method, Ag-polymer bioconjugates were combined with unconjugated PLG at various ratios to give calculated Ag loadings in particles as described in Table 4. The method has been described in our previous publications. To prepare smaller, approximately 80-120 nm acPLGs, the nanoprecipitation method was employed. Briefly, 100 mg of PLG (Ag-polymer bioconjugates and unconjugated PLG at desired ratios) was dissolved in acetonitrile at a concentration of 1 mg/mL and poured into 300 mL of MilliQ water under rapid stirring. The solutions were stirred for 24-48 h to completely remove residual acetonitrile. The acPLG particles were recovered using an ultracentrifuge membrane filter 10 kDa MWCO at 4000×g. Cryoprotectants (4% (w/v) sucrose and 3% (w/v) mannitol) were then added to the particles before lyophilization.

Nanoparticle Characterization

The size and zeta potential of the nanoparticles was determined by dynamic light scattering (DLS) by mixing 10 µL of a 25 mg/mL particle solution into 990 µL of MilliQ water using a Malvern Zetasizer ZSP (Westborough, MA). The release of peptide from PLG(OVA323-339) and acPLG-OVA323-339 particles was measured over 72 hr. Approximately 8 mg of each particle was dispersed in 1 mL of PBS and incubated at 37° C. At pre-determined time points, the particles were centrifuged at 7000×g for 5 min and 0.5 mL of supernatant was collected. The particles were resuspended and 0.5 mL of fresh PBS was added to each sample. All supernatant samples were stored at −20° C. until the experiment was completed. After the final time point, the pellet of particles was dissolved in DMSO and the total amount of remaining protein was determined. Protein content was determined using the Micro BCA assay (Pierce, Waltham, MA).

OVA323-339-IgG1 Binding In Vitro

OVA323-339 antibody (Innovagen, Sweden) was fluorescently labeled with FITC using Abcam Easy Link FITC Conjugation Kit (Abcam, Cambridge, MA). 20 µg of acPLG particles were incubated with 1 mg/mL FITC-labeled OVA323-339 antibody for 20 min at 4° C. and washed. Fluorescence was measured using a Beckman Coulter CyAn ADP Analyzer (Indianapolis, IN). Statistical differences between groups was determined by performing a one-way ANOVA and Tukey's Post-hoc test ($p<0.05$).

Cell Culture

BMDC media consisted of RPMI containing L-glutamine (Life Technologies, Carlsbad, CA) supplemented with penicillin (100 units/mL), streptomycin (100 mg/mL), 10% heat-inactivated fetal bovine serum (FBS) (Invitrogen Corporation, Carlsbad, CA) and 50 mM p-mercaptoethanol (Sigma Aldrich). Co-culture media was the same without p-mercaptoethanol and supplemented with 1 mM sodium pyruvate, and 0.1 mM non-essential amino acids (Life Technologies, Carlsbad, CA).

Antibodies and Flow Cytometry

FcR blocking was performed with anti-CD16/32 (Biolegend) prior to staining with various combinations of the following antibodies: anti-CD4 (RM4-5), -CD25 (PC61) (Biolegend), and -Foxp3 (FJK-16s) (eBioscience, San Diego, CA). Viability was assessed with fixable violet dead cell stain kit (Invitrogen, Carlsbad, CA). Foxp3 staining was performed with eBioscience staining kit according to the manufacturer's protocol. Cytometric data were collected using a Beckman Coulter CyAn ADP Analyzer. Analysis was performed using FlowJo (FlowJo, Ashland, OR).

Cell Isolation and In Vitro Treg Induction Assay

Treg induction assays were carried out with slight modifications as described. $CD4^+CD25^-Foxp3^-$ T cells were isolated from the spleen of OT-II mice using a naïve $CD4^+$ T cell isolation kit (Miltenyi Biotec, San Diego, CA). The assay was carried out in T cell media. Bone marrow-derived dendritic cells ($2\times10^4$/well) were seeded into 96-well round-bottom cell culture plates and incubated with acPLG-OVA323-339 of various particle concentrations and Ag loadings for 3 hours. Following incubation, all wells were washed to remove excess particles that had not been internalized by cells. Cells were co-cultured with $2\times10^4$/well naïve T cells in the presence of 2 ng/mL TGF-β1 (Cell Signaling Technology, Danvers, MA). Groups receiving antigen in lieu of acPLG-OVA323-339 received soluble OVA323-339 (100 ng/mL) at this time. After 4 days of co-culture, the T cells were collected, stained for viability, CD4, CD25, and Foxp3, and analyzed using flow cytometry. Statistical differences between groups was determined by performing a one-way ANOVA and Tukey's Post-hoc test ($p<0.05$).

R-EAE Disease Induction and Measurement

R-EAE was induced by immunization with encephalitogenic peptides as previously described. To induce R-EAE with PLP139-151 or both PLP139-151 and PLP178-191, mice were immunized by s.c. administration of 100 µL of 1 mg/mL PLP139-151/complete Freund's adjuvant (CFA) or 0.25 mg/mL of PLP139-151/CFA and 0.5 mg/mL of PLP178-191/CFA, respectively, distributed over 3 spots on the nape and hind flanks of SJL/J mice. Disease severity in individual mice was assessed using a 0 to 5 point scale: 0=no disease, 1=limp tail or hind limb weakness, 2=limp tail and hind limb weakness, 3=partial hind limb paralysis, 4=complete hind limb paralysis, 5=moribund. Differences between disease courses of different treatment groups were analyzed for statistical significance using the Kruskal-Wallis test. Table 5: Size and zeta potential of the nanoparticle formulations used in this study. Ag loading (µg Ag/mg PLG) was precisely controlled by combining PLG-Ag conjugates with unconjugated PLG at predetermined mixing ratios. *acPLG-$PLP_{139-151, 178-191}$ particles contained 8 µg/mg of both $PLP_{139-151}$ and $PLP_{178-191}$.

| Particle | Loading (µg/mg) | Size (nm ± S.D.) | Zeta (mV ± S.D.) |
|---|---|---|---|
| PLG | 0 | 521.5 ± 23.0 | −56.0 ± 0.7 |
| acPLG-OVA$_{323-339}$ | 2 | 322.0 ± 4.0 | −49.9 ± 4.9 |
| acPLG-OVA$_{323-339}$ | 4 | 326.6 ± 5.8 | −44.7 ± 1.5 |
| acPLG-OVA$_{323-339}$ | 8 | 321.5 ± 8.5 | −43.8 ± 1.8 |
| acPLG-OVA$_{323-339}$ | 25 | 345.5 ± 5.2 | −37.9 ± 0.4 |
| acPLG-OVA$_{323-339}$ | 50 | 468.0 ± 6.5 | −36.4 ± 0.7 |
| acPLG-OVA$_{323-339}$ | 150 | 558.1 ± 5.3 | −38.9 ± 0.5 |
| acPLG-PLP$_{139-151}$ | 8 | 656.5 ± 13.7 | −45.5 ± 1.4 |
| acPLG-PLP$_{178-191}$ | 8 | 490.9 ± 15.0 | −51.3 ± 1.0 |
| acPLG-PLP$_{139-151, 178-191}$ | 16* | 454.7 ± 17.4 | −45.0 ± 0.9 |
| PLG(PLP$_{139-151}$) | 1.4 | 384.7 ± 10.4 | −45.9 ± 0.8 |
| PLG | 0 | 72.2 ± 1.9 | −33.5 ± 1.1 |
| acPLG-OVA$_{323-339}$ | 0.1 | 74.8 ± 0.3 | −34.5 ± 0.3 |
| acPLG-OVA$_{323-339}$ | 0.5 | 85.6 ± 1.9 | −31.5 ± 1.2 |
| acPLG-OVA$_{323-339}$ | 1 | 103.9 ± 0.3 | −32.4 ± 0.6 |
| acPLG-OVA$_{323-339}$ | 2 | 112.0 ± 0.6 | −32.0 ± 0.9 |

Example 11

Modification of Ovalbumin Protein with Poly(Lactide-Co-Glycolide), TIMP Formulation, and In Vitro Treg Induction Assay

Covalent modification of polymers with proteins offers numerous advantages to improve the physicochemical properties of nanoparticulate drug delivery systems. Importantly, properties such as protein loading as well as nanoparticle size and zeta potential are easier to control.

Ovalbumin contains numerous CD4 (OVA323-334; OVA265-280), CD8 (OVA257-264), and B cell epitopes. One of the outstanding questions is whether TIMP encapsulating complete ovalbumin (TIMP-OVA) is capable of tolerizing all antigenic epitopes on CD4, CD8 and B cells. Because the precise number of these epitopes is known within the ovalbumin protein and the particles being used can exquisitely control the amount of protein and polymer used, the molecular quantities of antigen required to tolerize differential T and B cell receptors can be addressed. As such the dose for different T cell epitopes within the same protein can be addressed.

General Experimental Design

Full-length ovalbumin (OVA) protein was conjugated to high molecular weight and low molecular weight PLGA. Furthermore, once the conjugation was confirmed, TIMP-OVA particles with various controlled loadings of OVA were prepared and characterized.

The progression of experiments is as follows:
1. Synthesis of PLGA-OVA bioconjugates using EDC/NETS chemistry.
2. Solubility testing of resultant PLGA-OVA conjugates in DCM and DMSO to determine suitability for use in particle formation.
3. Determination of the coupling efficiency of PLGA-OVA conjugates thus enabling TIMP-OVA particles to be prepared at various and pre-determined Ag loadings.
4. Formulation of TIMP-OVA particles with Ag-loadings that varied from 0 to 150 µg OVA/mg PLGA.
5. Characterization of TIMP-OVA particles by DLS and zeta potential analysis.

TABLE 6

Reagents for synthesis of PLGA-OVA bioconjugates:

| Compound | Molecular weight (g/mol) |
| --- | --- |
| N-(3-dimethylaminopropyl)-N'-ethylcarbodiimide hydrochloride (EDC) | 191.70 |
| N-hydroxysuccinimide (NETS) | 115.09 |
| Poly(lactide-co-glycolide) (low molecular weight) | 4200 |
| Poly(lactide-co-glycolide) (high molecular weight) | 43478 |
| Ovalbumin grade V (OVA) | 44278 |
| N,N-Diisopropylethylamine (DIPEA) | 129.24 |

OVA contains 20 lysine groups available for covalent modification. Additionally, 14 aspartic acids and 33 glutamic acids are contained within OVA.

Due to the differential solubility of PLGA and OVA, a solvent system to perform the conjugation reactions as well as the appropriate stoichiometric ratio of PLGA to OVA needs to be determined to yield a polymer-Ag conjugate with high solubility in organic solvents such as DCM or DMSO that are necessary for particle fabrication.

To address these questions experimentally, varying the molar ratio of PLGA to OVA from 5 to 20 six-conjugation reactions were performed. A maximum ratio of 20 PLGA: 1 OVA was chosen based on the protein structure of OVA where 20 lysine residues are available for coupling with the terminal carboxylic acid group of PLGA. Furthermore, two molecular weights of PLGA were tested for conjugation efficiency and solubility testing. The choice of these reaction conditions was determined to yield the greatest potential to obtain a PLGA-OVA bioconjugate with the necessary Ag contents and solubility requirements. A summary of the reactions conditions is presented in Table 7.

Table 7 shows conditions for Ovalbumin conjugation. 6 reaction conditions were evaluated with the goal to completely solubilize OVA and PLGA in the same solvent system during the reaction. Furthermore, the stoichiometric ratio of PLGA to OVA was varied to yield a final product that was soluble in dimethyl sulfoxide (DMSO).

TABLE 7

Conditions for Ovalbumin conjugation

| Lot no. | Stoichiometric ratio (PLGA:OVA) |
| --- | --- |
| 03-23-L1 (LMW PLGA) | 5 |
| 03-23-L2 (LMW PLGA) | 10 |
| 03-23-L3 (LMW PLGA) | 20 |
| 03-23-H1 (HMW PLGA) | 5 |
| 03-23-H2 (HMW PLGA) | 10 |
| 03-23-H3 (HMW PLGA) | 20 |

Table 8 shows reaction conditions for Ovalbumin conjugation using low (L) and high (H) molecular weight PLGA. PLGA was prepared at a concentration of 25 mg/mL in DMSO. OVA was prepared at a concentration of 25 mg/mL in MilliQ water. Prior to addition of OVA to the solution containing PLGA, the concentration of PLGA was adjusted to 5 mg/mL to prevent precipitation of the polymer during the conjugation reaction. Furthermore, the solvent ratio was maintained to contain between 15-20 Vol/Vol % MilliQ water in DMSO during the conjugation of PLGA to OVA.

TABLE 8

Reaction conditions for Ovalbumin conjugation

| Reagents | 03-23-L1 | 03-23-L2 | 03-23-L3 |
| --- | --- | --- | --- |
| PLGA (25 mg/mL) | 949 µL | 1.89 mL | 3.79 mL |
| EDC (50 mg/mL) | 216.6 µL | 433 µL | 866 µL |
| NHS (25 mg/mL) | 260 µL | 520 µL | 1040 µL |
| DIPEA | 9.84 µL | 19.7 µL | 39.4 µL |
| Additional DMSO | 3.8 mL | 7.594 mL | 15.188 mL |
| OVA (25 mg/mL) | 2 mL | 2 mL | 2 mL |
| Additional water | | | 1.69 mL |

| Reagents | 03-23-H1 | 03-23-H2 | 03-23-H3 |
| --- | --- | --- | --- |
| PLGA (25 mg/mL) | 3.92 mL | 3.92 mL | 3.92 mL |
| EDC (50 mg/mL) | 86 µL | 172 µL | 344 µL |
| NHS (25 mg/mL) | 103.5 µL | 207 µL | 414 µL |
| DIPEA | 3.92 µL | 7.84 µL | 15.68 µL |
| Additional DMSO | 15.7 mL | 15.7 mL | 15.7 mL |
| OVA (25 mg/mL) | 0.8 mL | 0.4 mL | 0.2 mL |
| Additional water | 2.69 mL | 3.13 mL | 3.40 mL |

Protocol for PLGA-OVA Conjugation Using Volumes Listed in Table 7.

The following protocol was used. A 60 mL glass scintillation vial containing a magnetic stirbar was prepared. Separately, a 20 mL glass scintillation vial containing the appropriate amount of OVA, additional water, and DIPEA was prepared. The appropriate amount of PLGA dissolved in DMSO and the specified additional DMSO was added to the 60 mL scintillation vial. Under stirring (300-600 RPM) the appropriate amount of EDC was added dropwise to the PLGA solution and stirred for 5 min. Under stirring (300-600 RPM) the appropriate amount of NHS was added dropwise to the EDC-activated PLGA solution and stirred for an additional 10 min. Under stirring (300-600 RPM) the water solution containing OVA and DIPEA was added dropwise to the NHS-activated PLGA solution. (Note that the solutions should be transparent when finished adding this solution to PLGA.) The reaction was allowed to proceed overnight at room temperature. To recover the PLGA-OVA conjugate, the product-containing solution was transferred to a 3500 Da MWCO dialysis membrane and dialyze against 4L of MilliQ water for 2 days to remove any unreacted EDC/NHS/DIPEA and to remove DMSO. (Note: the product may precipitate in the dialysis bag. Change the water in the dialysis beaker at least 6 times over 2 days.) To collect the product, the precipitate was transferred from the dialysis bag to 50 mL conical centrifuge tubes. The material was centrifuged at 7000×g for 15 min at 4° C. to pellet the product. The product was washed by resuspension and centrifugation twice more. The final product was resuspended in 5 mL of MilliQ water, freeze, and lyophilize for 2 days or until the product is dry.

PLGA-OVA Conjugate Solubility Testing.

To evaluate the solubility of PLGA-OVA conjugates in solvent utilized for particle formulation, approximately 1 mg of conjugate was placed into a 1.5 mL MCT. The results are presented in Table 9. It was identified that conjugates 03-23-L3, and 03-23-H1-3 were soluble in DMSO. This enabled those conjugates to be characterized further.

Table 9 shows solubility testing of PLG-OVA polymer conjugates in DMSO. The precipitate observed after DCM addition is minimal in all cases and does not appear like it would affect particle formation.

TABLE 9

Solubility testing of PLG-OVA polymer conjugates in DMSO

| Polymer | Comments |
| --- | --- |
| 03-23-L1 | Not soluble in water, 50:50 DMSO:water, or DMSO |
| 03-23-L2 | Not soluble in water, 50:50 DMSO:water, or DMSO |
| 03-23-L3 | Soluble DMSO. Slight precipitate with DCM added. |
| 03-23-H1 | Soluble DMSO. Slight precipitate with DCM added. |

TABLE 9-continued

Solubility testing of PLG-OVA polymer conjugates in DMSO

| Polymer | Comments |
| --- | --- |
| 03-23-H2 | Soluble DMSO. Slight precipitate with DCM added. |
| 03-23-H3 | Soluble DMSO. No precipitate with DCM added. |

BCA Assay of PLG-OVA Conjugates to Determine Coupling Efficiency.

Due to the insolubility of 03-23-Li and 03-23-L-2 in DMSO, these samples were not evaluated for protein content.

The protein content present per milligram of polymer was determined using the Pierce BCA protein assay kit (Cat no. 23225). Results are reported in Table 10.

TABLE 10

Concentration of PLGA-OVA conjugates in DMSO and measured protein content using the BCA assay.

| Polymer conjugate | Concentration of PlG-OVA in DMSO used for BCA assay | Protein content (µg/mg) |
| --- | --- | --- |
| 03-23-L3 | 2 mg/mL | 379 ± 5.5 |
| 03-23-H1 | 5 mg/mL | 141 ± 9.8 |
| 03-23-H2 | 10 mg/mL | 59.4 ± 1.9 |
| 03-23-H3 | 20 mg/mL | 38.1 ± 4.7 |

Protocol for Particle Fabrication Using PLGA-OVA Conjugate 03-23-L3

TABLE 11

Formulation parameters for TIMP-OVA with varied Ag loading.

| Formulation | Ag loading | PLG-OVA conjugate | PLGA | Total |
| --- | --- | --- | --- | --- |
| 1 | 150 | 11.86 mg | 18.14 mg | 30 mg |
| 2 | 50 | 9.88 mg | 65.12 mg | 75 mg |
| 3 | 25 | 9.88 mg | 140.12 mg | 150 mg |
| 4 | 8 | 3.16 mg | 146.84 mg | 150 mg |
| 5 | 4 | 1.58 mg | 148.42 mg | 150 mg |
| 6 | 2 | 0.79 mg | 149.21 mg | 150 mg |
| 7 | 0.5 | 0.2 mg | 149.80 mg | 150 mg |
| 8 | 0 | 0 mg | 150 mg | 150 mg |
| Total | | 37.36 mg | 967.64 mg | 1005 mg |

PLGA at a concentration of 200 mg/mL in DCM was prepared.

PLG-OVA (03-23-L-3) at a concentration of 25 mg/mL in DMSO was prepared.

TABLE 12

Formulation specifications for production of TIMP-OVA with various Ag loading.

| Formulation | Ag loading | PLG-OVA conjugate | PLGA | Total | 1% PEMA | 0.5% PEMA |
|---|---|---|---|---|---|---|
| 1 | 150 | 474.4 µL | 907 µL (20 mg/mL) | 30 mg | 3.75 mL | 30 mL |
| 2 | 50 | 395.2 µL | 1628 µL (40 mg/mL) | 75 mg | 5 mL | 75 mL |
| 3 | 25 | 395.2 µL | 1401.2 µL (100 mg/mL) | 150 mg | 10 mL | 150 mL |
| 4 | 8 | 126.4 µL | 734.2 µL (200 mg/mL) | 150 mg | 10 mL | 150 mL |
| 5 | 4 | 63.2 µL | 742.1 µL (200 mg/mL) | 150 mg | 10 mL | 150 mL |
| 6 | 2 | 746.1 µL | 31.6 µL (200 mg/mL) | 150 mg | 10 mL | 150 mL |
| 7 | 0.5 | 8 µL | 749 µL (200 mg/mL) | 150 mg | 10 mL | 150 mL |
| 8 | 0 | 0 µL | 750 µL (200 mg/mL) | 150 mg | 10 mL | 150 mL |
| Total | | 37.36 mg | 967.64 mg | 1005 mg | | |

Procedure for TIMP-OVA Formulation

The following protocol was used.

1.1. Clean the sonicator with acetone, ethanol and then water.

1.2. Pipette the appropriate volume of PLGA as noted in the above table into a 20 mL scintillation vial.

1.3. Pipette the appropriate volume of PLG-OVA as noted in the above table into the same 20 mL scintillation vial from step 1.2.

1.4. Add the appropriate volume of 1% PEMA to the 20 mL scintillation vial containing PLGA and PLG-OVA.

1.5. Sonicate the solution for 30 seconds at 100% amplitude.

1.6. Pour sonicated mixture into the appropriate volume of 0.5% w/v poly(ethylene-alt-maleic anhydride) dissolved in water under stirring at 300 RPM.

1.7. Stir particles overnight to evaporate dichloromethane.

1.8. Prepare solutions of cryoprotectants (sucrose 10 g/25 mL MilliQ water; mannitol 6 g/20 mL MilliQ water). The mannitol solution will take time to dissolve and will require heating. Heat at 70° C. for 15-30 min with frequent vortexing. Upon storage, the mannitol will crystalize out of solution and need to be heated again. The sucrose solution should be soluble at all times. It is acceptable to use premade solutions and heat up the mannitol again.

1.9. Pass particle solution through a 40 µm cell strainer. Distribute the solution into 50 mL falcon tubes.

1.10. Allow particles to chill on ice for 15 min.

1.11. Centrifuge under a relative centrifugal force of 7000×g for 15 minutes at 4° C. 1.12. Aspirate supernatant completely.

1.13. Add 3 mL of 1 M sodium bicarbonate-sodium carbonate buffer to each tube and allow particles to chill on ice for 15 min.

1.14. Resuspend the pellets using a 1 mL pipette or a pipette aid equipped with a 5 mL serological pipette.

1.15. After the pellet is dispersed well (no visible aggregates), add 1 M sodium bicarbonate-sodium carbonate buffer to each tube until total volume is 25 mL.

1.16. Centrifuge under a relative centrifugal force of 7000×g for 15 minutes at 4° C. 1.17. Aspirate supernatant completely.

1.18. Add 3 mL of 1 M sodium bicarbonate-sodium carbonate buffer to each tube and allow particles to chill on ice for 15 min.

1.19. Resuspend the pellets. After the pellet is dispersed well, add 1 M sodium bicarbonate-sodium carbonate buffer to each tube until the total volume is 25 mL.

1.20. Centrifuge under a relative centrifugal force of 7000×g for 15 minutes at 4° C.

1.21. Aspirate supernatant completely.

1.22. Add 3 mL of MilliQ water into the tube and allow particles to chill on ice for 15 min.

1.23. Resuspend the pellet. After the pellet is dispersed well, add additional MilliQ water until the particle concentration is between 4-8 mg/mL. Assuming that the recovery of particle will be 40%.

1.24. Homogeneously disperse the particles in the water.

1.25. Pass particle solution through a 40 µm cell strainer.

1.26. Prepare sample tubes for lyophilization, 2 mL tubes for particle aliquoting. Pre-mass at least 1-3 of those tubes to determine the amount of particles per tube.

1.27. Pipette 800 µL of the particle solution into each tube and save at least 200 µL of particle solution for characterization by DLS/Zeta analysis in a 1.5 mL microcentrifuge tube (only need to use 20 µL of particle sample in MilliQ water to perform DLS/Zeta analysis).

1.28. For each sample tube that gets cryoprotectant, mix 100 µL of the sucrose and 100 µL of the mannitol solutions together and add to the particles with mixing by pipette. The total volume per tube will now be 1 mL. The concentration of cryoprotectant will be 4% w/v sucrose and 3% w/v Mannitol.

1.29. Freeze all samples, including the ones with no cryoprotectant, except for the sample to be used for DLS/Zeta analysis (put in 4 deg. Fridge for characterization later) in the −80 freezer for at least 5 hr.

1.30. Lyophilize the samples for 1-2 days.

TABLE 13

Measurement of the size and zeta potential of TIMP-OVA particles

| Particle | Size (nm) | Zeta potential (mV) | PDI |
|---|---|---|---|
| TIMP-OVA150 | 847.7 ± 33.4 | −60.4 ± 1.2 | 0.710 |
| TIMP-OVA50 | 464.0 ± 12.8 | −28.6 ± 0.2 | 0.410 |
| TIMP-OVA25 | 340.6 ± 6.2 | −29.1 ± 0.9 | 0.190 |
| TIMP-OVA8 | 405.8 ± 8.8 | −34.7 ± 0.9 | 0.270 |
| TIMP-OVA4 | 386.2 ± 2.5 | −33.0 ± 0.6 | 0.260 |
| TIMP-OVA2 | 518.5 ± 3.4 | −34.9 ± 0.9 | 0.370 |
| TIMP-OVA0.5 | 391.1 ± 3.8 | −35.6 ± 0.4 | 0.230 |
| PLG blank (IMP) | 286.9 ± 0.4 | 39.7 ± 0.3 | 0.130 |

Evaluation of the Biological Activity of TIMP-OVA Conjugates Using an In Vitro Reg Induction Assay.

The objective of this study was to determine the effect of antigen loading in polymer conjugate TIMP-OVA on the induction of naïve CD4+ T cells (OTII) to regulatory T cells (CD4+CD25+Foxp3+).

Experimental Groups:

| Particle | Ag or particle dose | | TGF-b dose |
|---|---|---|---|
| TGF ONLY | 0 | ng/mL | 2 ng/mL |
| OVA323-339 | 100 | ng/mL | 2 ng/mL |
| OVA | 100 | ng/mL | 2 ng/mL |
| OVA | 1000 | ng/mL | 2 ng/mL |
| OVA | 10000 | ng/mL | 2 ng/mL |
| TIMP(OVA) 02-204 10 µg/mg | 300 | µg/mL | 2 ng/mL |
| TIMP-OVA323-339 8 µg/mg | 300 | µg/mL | 2 ng/mL |
| TIMP-OVA 150 µg/mg | 5, 10, 75, 150, 300 | µg/mL | 2 ng/mL |
| TIMP-OVA 25 µg/mg | 5, 10, 75, 150, 300 | µg/mL | 2 ng/mL |
| TIMP-OVA 8 µg/mg | 5, 10, 75, 150, 300 | µg/mL | 2 ng/mL |
| TIMP-OVA 2 µg/mg | 5, 10, 75, 150, 300 | µg/mL | 2 ng/mL |
| PLG blank (IMP) | 300 | µg/mL | 2 ng/mL |

The amount of OVA antigen per mL of media was calculated based on the dose of TIMP-OVA and the loading amount of OVA protein per mg of TIMP. The bolded and italicized cells in Table 14 indicate the particles that were tested in the Treg experiment. Importantly, the amount of Ag delivered per well covered significant breadth from 0 ng/mL to 45000 ng/mL.

TABLE 14

Antigen calculation per mL in each well treated with TIMP-OVA

| Particle loading (µg/mg)/Concentration (µg/mg) | 0 | 5 | 10 | 75 | 150 | 300 |
|---|---|---|---|---|---|---|
| 0 | 0 | 0 | 0 | 0 | 0 | 0 |
| *2* | 0 | 10 | 20 | 150 | 300 | 600 |
| 4 | 0 | 20 | 40 | 300 | 600 | 1200 |
| *8* | 0 | 40 | 80 | 600 | 1200 | 2400 |
| *25* | 0 | 125 | 250 | 1875 | 3750 | 7500 |
| 50 | 0 | 250 | 500 | 3750 | 7500 | 15000 |
| *150* | 0 | 750 | 1500 | 11250 | 22500 | 45000 |

Bone Marrow Derived Dendritic Cell Culture (Following the Method of Lutz et al.)

The preparation of BMDCs was performed as described previously. DCs were prepared by culturing bone marrow cells obtained from C57BL/6 mice. Bone marrow cells were flushed from the tibias and femurs using a needle-equipped syringe. The recovered cells were incubated in ACK lysis buffer to lyse red blood cells. The bone marrow cells were cultured in RPMI-1640 medium supplemented with 10% fetal bovine serum, 100 units/mL penicillin, 100 mg/mL streptomycin, 2 mM L-glutamine, 50 uM 2-mercaptoethanol, and 20 ng/mL granulocyte-macrophage colony-stimulating factor. The culture medium was changed on days 3, 6, and 8. The cells were ready to use on day 10.

Cell Isolation and In Vitro Treg Induction Assay

CD4+CD25−foxp3− T cells were isolated from the spleen of OT-II mice (B6.Cg-Tg(TcraTcrb)425Cbn/J, Jackson Laboratory, Bar Harbor, ME) using a naïve CD4+ T cell isolation kit (Miltenyi Biotec, San Diego, CA). The assay was carried out in RMPI media supplemented with 10% fetal bovine serum, 1% pen/strep, and non-essential amino acids. APCs ($2\times10^4$/well) were seeded into 96 well round bottom cell culture plates and treated with soluble OVA323-339 peptide (100 ng/mL) or particles with various Ag-loadings or particle doses and co-cultured with $2\times10^4$/well naïve T cells in the presence of 2 ng/mL TGF□. After 4 days of co-culture, the T cells were collected and stained for CD4, CD25, and Foxp3 and analyzed using the Cyan cytometer.

CONCLUSIONS

PLGA-OVA bioconjugates were successfully synthesized using EDC/NHS (carbodiimide) chemistry. Using the BCA assay, the protein content per mg of PLGA-OVA bioconjugate was determined. The amount of protein per mg was dependent on the polymer molecular weight as well as the stoichiometric ratio of PLGA:OVA. The PLGA-OVA conjugate with the highest protein content was 03-23-L3 and the lowest was 03-23-H3.

As a starting point, TIMP-OVA particles were formulated with various Ag loadings from 0 µg/mg to 150 µg/mg using the PLGA-OVA conjugate 03-23-L3 due to its high protein loading capability. TIMP-OVA particles prepared using 03-23-L3 displayed sizes measured by DLS between 300 nm and 850 nm. TIMP-OVA 150 µg/mg displayed an unusually high PDI greater than 0.7. The zeta potentials of TIMP-OVA ranged between −30 and −60 mV.

Preliminary in vitro testing using a Treg induction assay that characterized the ability of various TIMP-OVA particles to induce regulatory T cells in the presence of TGFb indicated that the protein remained active following conjugation and TIMP formulation. It should be noted that TIMP-OVA did not appear to be as effective as TIMP-OVA323-339 or TIMP(OVA) particles with similar loadings.

While specific embodiments of the invention have been described and illustrated, such embodiments should be considered illustrative of the invention only and not as limiting the invention as construed in accordance with the accompanying claims.

All patents, applications and other references cited herein are incorporated by reference in their entireties.

SEQUENCE LISTING (5140 sequences)

SEQ ID NO: 1 - protein, 21 aa, Mus musculus
MEVGWYRSPFSRVVHLYRNGK

SEQ ID NO: 2 - protein, 9 aa, Homo sapiens
ASFDKAKLK

SEQ ID NO: 3 - protein, 14 aa, Oryctolagus cuniculus
ASQKRPSQRHGSKY

SEQ ID NO: 4 - protein, 20 aa, Homo sapiens
ASQKRPSQRHGSKYLATAST

SEQ ID NO: 5 - protein, 20 aa, Homo sapiens
ATGLCFFGVALFCGCGHEAL

SEQ ID NO: 6 - protein, 20 aa, Homo sapiens
AVPVYIYFNTWTTCQSIAFP

SEQ ID NO: 7 - protein, 9 aa, Human herpesvirus
CLGGLLTMV

SEQ ID NO: 8 - protein, 9 aa, Human herpesvirus
CRVLCCYVL

SEQ ID NO: 9 - protein, 9 aa, Homo sapiens
DAKIRIFDL

SEQ ID NO: 10 - protein, 18 aa, Homo sapiens
DTPYLDITYHFVMQRLPL

SEQ ID NO: 11 - protein, 15 aa, unidentified
  REGION 1..15: note = epitope involved in multiple sclerosis
ENPVVAFFKNIVTPR

SEQ ID NO: 12 - protein, 15 aa, unidentified
  REGION 1..15: note = epitope involved in multiple sclerosis
ENPVVDFFKNIVTPR

SEQ ID NO: 13 - protein, 15 aa, unidentified
  REGION 1..15: note = epitope involved in multiple sclerosis
ENPVVHFFANIVTPR

SEQ ID NO: 14 - protein, 17 aa, unidentified
  REGION 1..17: note = epitope involved in multiple sclerosis
ENPVVHFFANIVTPRTP

SEQ ID NO: 15 - protein, 15 aa, Homo sapiens
ENPVVHFFKNIVTPR

SEQ ID NO: 16 - protein, 17 aa, Homo sapiens
ENPVVHFFKNIVTPRTP

SEQ ID NO: 17 - protein, 20 aa, Homo sapiens
FGDYKTTICGKGLSATVTGG

SEQ ID NO: 18 - protein, 9 aa, Homo sapiens
FLYGALLLA

SEQ ID NO: 19 - protein, 21 aa, Homo sapiens
FYYTTGAVRQIFGDYKTTICG

SEQ ID NO: 20 - protein, 24 aa, Human herpesvirus
GGDNHGRGRGRGRGRGGGRPGAPG

SEQ ID NO: 21 - protein, 9 aa, Human herpesvirus
GLCTLVAML

SEQ ID NO: 22 - protein, 13 aa, Mus musculus
HCLGKWLGHPDKF

SEQ ID NO: 23 - protein, 18 aa, Mus musculus
IFKLGGRDSRSGSPMARR

SEQ ID NO: 24 - protein, 15 aa, Homo sapiens
ITREEKPAVTAAPKK

SEQ ID NO: 25 - protein, 13 aa, Homo sapiens
IVTPRTPPPSQGK

SEQ ID NO: 26 - protein, 20 aa, Homo sapiens
KGLSATVTGGQKGRGYRGQH

SEQ ID NO: 27 - protein, 14 aa, Homo sapiens
KIFKLGGRDSRSGS

SEQ ID NO: 28 - protein, 20 aa, Homo sapiens
LFCGCGHEALTGTEKLIETY

SEQ ID NO: 29 - protein, 10 aa, Human herpesvirus
LLDFVRFMGV

SEQ ID NO: 30 - protein, 9 aa, Human herpesvirus
LLWTLVVLL

SEQ ID NO: 31 - protein, 20 aa, Homo sapiens
LPRHRDTGILDSIGRFFGGD

SEQ ID NO: 32 - protein, 20 aa, Homo sapiens
LVGAPFASLVATGLCFFGVA

SEQ ID NO: 33 - protein, 20 aa, Homo sapiens
LYGALLLAEGFYTTGAVRQI

SEQ ID NO: 34 - protein, 19 aa, Homo sapiens
MAATYNFAVLKLMGRFTKF

SEQ ID NO: 35 - protein, 13 aa, Human herpesvirus
MDRPRTPPPSYSE

SEQ ID NO: 36 - protein, 9 aa, Human herpesvirus
NLVPMVATV

SEQ ID NO: 37 - protein, 20 aa, Mus musculus
NPVVHFFKNIVTPRTPPPSQ

SEQ ID NO: 38 - protein, 14 aa, Mus musculus
NTWTTCQSIAFPSK

SEQ ID NO: 39 - protein, 20 aa, Homo sapiens
QKGRGSRGQHQAHSLERVCH

SEQ ID NO: 40 - protein, 8 aa, Human herpesvirus
RAKFKQLL

SEQ ID NO: 41 - protein, 9 aa, Human herpesvirus
RPPIFIRRL

SEQ ID NO: 42 - protein, 20 aa, Homo sapiens
SKTSASIGSLCADARMYGVL

SEQ ID NO: 43 - protein, 9 aa, Homo sapiens
SLSRFSWGA

SEQ ID NO: 44 - protein, 9 aa, Human herpesvirus
SVRDRLARL

SEQ ID NO: 45 - protein, 12 aa, unidentified
  REGION 1..12: note = epitope involved in multiple sclerosis
SVSVGMKPSPRP

SEQ ID NO: 46 - protein, 15 aa, Human herpesvirus
TGGVYHFVKKHVHES

SEQ ID NO: 47 - protein, 20 aa, Homo sapiens
TGTEKLIETYFSKNYQDYEY

SEQ ID NO: 48 - protein, 10 aa, Human herpesvirus
TPRVTGGGAM

SEQ ID NO: 49 - protein, 20 aa, Homo sapiens
VDAQGTLSKIFKLGGRDSRS

SEQ ID NO: 50 - protein, 13 aa, Cavia porcellus
VHFFKNIVTPRTP

SEQ ID NO: 51 - protein, 9 aa, Homo sapiens
VMAPRTLVL

SEQ ID NO: 52 - protein, 20 aa, Mus musculus
VTPRTPPPSQGKGRGLSLSR

SEQ ID NO: 53 - protein, 9 aa, Homo sapiens
VVHFFKNIV

SEQ ID NO: 54 - protein, 20 aa, Homo sapiens
WTTCQSIAFPSKTSASIGSL

SEQ ID NO: 55 - protein, 23 aa, Human T-cell lymphotrophic virus
IQAIVSSPCHNSLILPPFSLSPV

SEQ ID NO: 56 - protein, 24 aa, Human T-cell lymphotrophic virus
LPPTAPPLLPHSNLDHILEPSIPW

SEQ ID NO: 57 - protein, 20 aa, Human T-cell lymphotrophic virus
PPPYVEPTAPQVLPVMHPHG

SEQ ID NO: 58 - protein, 23 aa, Human T-cell lymphotrophic virus
QGGLCKALQEQCRFPNITNSHVP

SEQ ID NO: 59 - protein, 20 aa, Human T-cell lymphotrophic virus
RASLSTWHVLYSPNVSVPSS

SEQ ID NO: 60 - protein, 10 aa, Homo sapiens
FFKNIVTPRT

SEQ ID NO: 61 - protein, 9 aa, Homo sapiens
FKNIVTPRT

SEQ ID NO: 62 - protein, 11 aa, Cavia porcellus
HFFKNIVTPRT

SEQ ID NO: 63 - protein, 15 aa, Homo sapiens
KGFKGVDAQGTLSKI

SEQ ID NO: 64 - protein, 13 aa, unidentified
  REGION 1..13: note = epitope involved in multiple sclerosis
VHFFKNIVTARTP

SEQ ID NO: 65 - protein, 13 aa, Homo sapiens
VVHFFKNIVTPRT

SEQ ID NO: 66 - protein, 9 aa, Human herpesvirus
SQAPLPCVL

SEQ ID NO: 67 - protein, 12 aa, unidentified
  REGION 1..12: note = epitope involved in multiple sclerosis
HTQPYAYEARDH

SEQ ID NO: 68 - protein, 15 aa, Bos taurus
FKADEKKFWGKYLYE

SEQ ID NO: 69 - protein, 16 aa, Homo sapiens
HCLGKWLGHPDKFVGI

SEQ ID NO: 70 - protein, 14 aa, Mus musculus
KTTICGKGLSATVT

SEQ ID NO: 71 - protein, 17 aa, Homo sapiens
VDDTQFVRFDSDAASPR

SEQ ID NO: 72 - protein, 22 aa, Mus musculus
EKLIETYFSKNYQDYEYLINVI

SEQ ID NO: 73 - protein, 9 aa, Mus musculus
ASQKRPSQR

SEQ ID NO: 74 - protein, 15 aa, Homo sapiens
DENPVVHFFKNIVTP

SEQ ID NO: 75 - protein, 19 aa, Homo sapiens
DENPVVHFFKNIVTPRTPP

SEQ ID NO: 76 - protein, 26 aa, Homo sapiens
FKGVDAQGTLSKIFKLGGRDSRSGSP

SEQ ID NO: 77 - protein, 18 aa, Homo sapiens
GTEKLIETYFSKNYQDYE

SEQ ID NO: 78 - protein, 16 aa, Homo sapiens
QSIAFPSKTSASIGSL

SEQ ID NO: 79 - protein, 25 aa, Homo sapiens
AQGTLSKIFKLGGRDSRSGSPMARR

SEQ ID NO: 80 - protein, 25 aa, Homo sapiens
ASDYKSAHKGLKGVDAQGTLSKIFK

SEQ ID NO: 81 - protein, 31 aa, Homo sapiens
EVGELSRGKLYSLGNGRWMLTLAKNMEVRAI

SEQ ID NO: 82 - protein, 18 aa, Homo sapiens
GFYTTGAVRQIFGDYKTT

SEQ ID NO: 83 - protein, 33 aa, Homo sapiens
GNGRWMLTLAKNMEVRAIFTGYYGKGKPVPTQG

SEQ ID NO: 84 - protein, 20 aa, Homo sapiens
GQFRVIGPRHPIRALVGDEV

SEQ ID NO: 85 - protein, 20 aa, Homo sapiens
HHPARTAHYGSLPQKSHGRT

SEQ ID NO: 86 - protein, 20 aa, Homo sapiens
KNIVTPRTPPPSQGKGRGLS

SEQ ID NO: 87 - protein, 20 aa, Homo sapiens
KYLATASTMDHARHGFLPRH

SEQ ID NO: 88 - protein, 19 aa, Homo sapiens
LSRFSWGAEGQRPGFGYGG

SEQ ID NO: 89 - protein, 21 aa, Homo sapiens
MEVGWYRPPFSRVVHLYRNGK

SEQ ID NO: 90 - protein, 20 aa, Homo sapiens
NTWTTCQSIAFPSKTSASIG

SEQ ID NO: 91 - protein, 20 aa, Homo sapiens
PIRALVGDEVELPCRISPGK

SEQ ID NO: 92 - protein, 12 aa, unidentified
  REGION 1..12: note = epitope involved in multiple sclerosis
QKSQRSQAENPV

SEQ ID NO: 93 - protein, 12 aa, Cavia porcellus
QKSQRSQDENPV

SEQ ID NO: 94 - protein, 20 aa, Homo sapiens
QRPGFGYGGRASDYKSAHKG

SEQ ID NO: 95 - protein, 20 aa, Homo sapiens
RHRDTGILDSIGRFFGGDRG

SEQ ID NO: 96 - protein, 20 aa, Homo sapiens
SKIFKLGGRDSRSGSPMARR

SEQ ID NO: 97 - protein, 21 aa, Homo sapiens
SKTSASIGSLCADARMYGVLP

SEQ ID NO: 98 - protein, 21 aa, Homo sapiens
TGTEKLIETYFSKNYQDYEYL

SEQ ID NO: 99 - protein, 13 aa, unidentified
  REGION 1..13: note = epitope involved in multiple sclerosis
VHFFRNIVTARTP

SEQ ID NO: 100 - protein, 13 aa, unidentified
  REGION 1..13: note = epitope involved in multiple sclerosis
VHFFRNIVTARTP

SEQ ID NO: 101 - protein, 20 aa, Homo sapiens
VVHFFKNIVTPRTPPPSQGK

SEQ ID NO: 102 - protein, 21 aa, Homo sapiens
ASQKRPSQRHGSKYLATASTM

SEQ ID NO: 103 - protein, 44 aa, Homo sapiens
ASQKRPSQRHGSKYLATASTMDHARHGFLPRHRDTGILDSIGRF

SEQ ID NO: 104 - protein, 21 aa, Homo sapiens
ASTMDHARHGFLPRHRDTGIL

SEQ ID NO: 105 - protein, 23 aa, Homo sapiens
AVRQIFGDYKTTICGKGLSATVT

SEQ ID NO: 106 - protein, 19 aa, Homo sapiens
ENPVVHFFKNIVTPRTPPP

SEQ ID NO: 107 - protein, 18 aa, Homo sapiens
GFYTTGAYRQIFGDYLTT

SEQ ID NO: 108 - protein, 20 aa, Homo sapiens
GRASDYKSAHKGFKGVDAQG

SEQ ID NO: 109 - protein, 25 aa, Homo sapiens
GVLPWNAFPGKVCGSNLLSICKTAE

SEQ ID NO: 110 - protein, 12 aa, unidentified
  REGION 1..12: note = epitope involved in multiple sclerosis
HLILAPSIRHAP

SEQ ID NO: 111 - protein, 12 aa, unidentified
  REGION 1..12: note = epitope involved in multiple sclerosis
HLVMAPSVARGL

SEQ ID NO: 112 - protein, 12 aa, unidentified
  REGION 1..12: note = epitope involved in multiple sclerosis
HVQLAPPIALRH

SEQ ID NO: 113 - protein, 12 aa, unidentified
  REGION 1..12: note = epitope involved in multiple sclerosis
HVVLAPNVQSPL

SEQ ID NO: 114 - protein, 24 aa, Homo sapiens
HYGSLPQKSHGRTQDENPVVHFFK

SEQ ID NO: 115 - protein, 14 aa, Homo sapiens
KKQSKPVTTPEEIA

SEQ ID NO: 116 - protein, 33 aa, Homo sapiens
KLIETYFSKNYQDYEYLINVIHAFQYVIYGTAS

SEQ ID NO: 117 - protein, 30 aa, Homo sapiens
LATASTMDHARHGFLPRHRDTGILDSIGRF

SEQ ID NO: 118 - protein, 23 aa, Homo sapiens
LTFMIAATYNFAVLKLMGRGTKF

SEQ ID NO: 119 - protein, 20 aa, Bos taurus
MIAATYNFAVLKLMGRGTKF

SEQ ID NO: 120 - protein, 21 aa, Homo sapiens
RHGSKYLATASTMDHARHGFL

SEQ ID NO: 121 - protein, 22 aa, Homo sapiens
SIAFPSKTSASIGSLCADARMY

SEQ ID NO: 122 - protein, 34 aa, Homo sapiens
TGGQKGRGSRGQHQAHSLERVCHCLGKWLGHPDK

SEQ ID NO: 123 - protein, 20 aa, Bos taurus
TTICGKGLSATVTGGQKGRG

SEQ ID NO: 124 - protein, 14 aa, Homo sapiens
VVTEIPKEEKDPGM

SEQ ID NO: 125 - protein, 12 aa, unidentified
  REGION 1..12: note = epitope involved in multiple sclerosis
WHAPQTPYWASM

SEQ ID NO: 126 - protein, 12 aa, unidentified
  REGION 1..12: note = epitope involved in multiple sclerosis
WHIPPNIGRTFS

SEQ ID NO: 127 - protein, 12 aa, unidentified
  REGION 1..12: note = epitope involved in multiple sclerosis
WHQTYTSSLWES

SEQ ID NO: 128 - protein, 12 aa, unidentified
  REGION 1..12: note = epitope involved in multiple sclerosis
WHTQPAHVVTPM

SEQ ID NO: 129 - protein, 12 aa, unidentified
  REGION 1..12: note = epitope involved in multiple sclerosis
WHTSDPLPPAQP

SEQ ID NO: 130 - protein, 26 aa, Homo sapiens
ALVGDEVELPCRISPGKNATGMELGW

SEQ ID NO: 131 - protein, 7 aa, unidentified
  REGION 1..7: note = epitope involved in multiple sclerosis
ARWELNL

SEQ ID NO: 132 - protein, 22 aa, Homo sapiens
AVRQIFGDYKTTICGKGLSATV

SEQ ID NO: 133 - protein, 20 aa, Homo sapiens
DTGILDSIGRFFGGDRGAPK

SEQ ID NO: 134 - protein, 20 aa, Homo sapiens
EKDRFSVNLDVSHFSPEELK

SEQ ID NO: 135 - protein, 7 aa, unidentified
  REGION 1..7: note = epitope involved in multiple sclerosis
EPLYGPY

SEQ ID NO: 136 - protein, 20 aa, Homo sapiens
FDTGLSEMRLEKDRFSVNLD

SEQ ID NO: 137 - protein, 26 aa, Homo sapiens
GQFRVIGPRHPIRALVGDEVELPCRI

SEQ ID NO: 138 - protein, 20 aa, Homo sapiens
GSGKDSHHPARTAHYGSLPQ

SEQ ID NO: 139 - protein, 15 aa, Homo sapiens
GSLPQKSHGRTQDEN

SEQ ID NO: 140 - protein, 20 aa, Homo sapiens
GVLTVNGPRKQVSGPERTIP

SEQ ID NO: 141 - protein, 23 aa, Homo sapiens
GWYRPPFSRVVHLYRNGKDQDGD

SEQ ID NO: 142 - protein, 20 aa, Homo sapiens
HGFISREFHRKYRIPADVDP

SEQ ID NO: 143 - protein, 20 aa, Homo sapiens
HGKHEERQDEHGFISREFHR

SEQ ID NO: 144 - protein, 20 aa, Homo sapiens
HLLESDLFPTSTSLSPFYLR

SEQ ID NO: 145 - protein, 25 aa, Homo sapiens
IGEGKVTLRIRNVRFSDEGGFTCFF

SEQ ID NO: 146 - protein, 20 aa, Homo sapiens
KYRIPADVDPLTITSSLSSD

SEQ ID NO: 147 - protein, 7 aa, unidentified
  REGION 1..7: note = epitope involved in multiple sclerosis
LATPNPS

SEQ ID NO: 148 - protein, 20 aa, Homo sapiens
LTITSSLSSDGVLTVNGPRK

SEQ ID NO: 149 - protein, 24 aa, Homo sapiens
LYRNGKDQDGDAPEYRGRTELLKD

SEQ ID NO: 150 - protein, 20 aa, Homo sapiens
MDIAIHHPWIRRPFFPFHSP

SEQ ID NO: 151 - protein, 7 aa, unidentified
  REGION 1..7: note = epitope involved in multiple sclerosis
PEFAPWA

SEQ ID NO: 152 - protein, 7 aa, unidentified
  REGION 1..7: note = epitope involved in multiple sclerosis
PEQPPIH

SEQ ID NO: 153 - protein, 25 aa, Homo sapiens
PEYRGRTELLKDAIGEGKVTLRIRN

SEQ ID NO: 154 - protein, 20 aa, Homo sapiens
PPSFLRAPSWFDTGLSEMRL

SEQ ID NO: 155 - protein, 20 aa, Homo sapiens
PVVHFFKNIVTPRTPPPSQG

SEQ ID NO: 156 - protein, 20 aa, Homo sapiens
QGKGRGLSLSRFSWGAEGQR

SEQ ID NO: 157 - protein, 20 aa, Homo sapiens
QVSGPERTIPITREEKPAVT

SEQ ID NO: 158 - protein, 25 aa, Homo sapiens
RDHSYQEEAAMELKVEDPFYWVSPG

SEQ ID NO: 159 - protein, 25 aa, Homo sapiens
RFSDEGGFTCFFRDHSYQEEAAMEL

SEQ ID NO: 160 - protein, 20 aa, Homo sapiens
RRPFFPFHSPSRLFDQFFGE

SEQ ID NO: 161 - protein, 24 aa, Homo sapiens [sequence omitted]

SEQ ID NO: 162 - protein, 20 aa, Homo sapiens
SRLFDQFFGEHLLESDLFPT

SEQ ID NO: 163 - protein, 20 aa, Homo sapiens
STSLSPFYLRPPSFLRAPSW

SEQ ID NO: 164 - protein, 7 aa, unidentified
  REGION 1..7: note = epitope involved in multiple sclerosis
SWYARHT

SEQ ID NO: 165 - protein, 7 aa, unidentified
  REGION 1..7: note = epitope involved in multiple sclerosis
SWYARHY

SEQ ID NO: 166 - protein, 7 aa, unidentified
  REGION 1..7: note = epitope involved in multiple sclerosis
TIKNTFF

SEQ ID NO: 167 - protein, 14 aa, Homo sapiens
TLSKIFKLGGRDSR

SEQ ID NO: 168 - protein, 7 aa, unidentified
  REGION 1..7: note = epitope involved in multiple sclerosis
TPTFMYF

SEQ ID NO: 169 - protein, 7 aa, unidentified
  REGION 1..7: note = epitope involved in multiple sclerosis
TSPSVAY

SEQ ID NO: 170 - protein, 7 aa, unidentified
  REGION 1..7: note = epitope involved in multiple sclerosis
TTPLTNL

SEQ ID NO: 171 - protein, 13 aa, Homo sapiens
VDAQGTLSKIFKL

SEQ ID NO: 172 - protein, 7 aa, unidentified
  REGION 1..7: note = epitope involved in multiple sclerosis
VDHQHPS

SEQ ID NO: 173 - protein, 20 aa, Homo sapiens
VKVLGDVIEVHGKHEERQDE

SEQ ID NO: 174 - protein, 20 aa, Homo sapiens
VSHFSPEELKVKVLGDVIEV

SEQ ID NO: 175 - protein, 7 aa, unidentified
  REGION 1..7: note = epitope involved in multiple sclerosis
YAQPSER

SEQ ID NO: 176 - protein, 15 aa, Homo sapiens
AAAQMPAYQELVEEA

SEQ ID NO: 177 - protein, 26 aa, Cavia porcellus
AARTTHYGSLPQKSQRSQDENPVVHF

SEQ ID NO: 178 - protein, 15 aa, Homo sapiens
AGVTLISPFVGRILD

SEQ ID NO: 179 - protein, 19 aa, Homo sapiens
ARRKVAMATTYYFDYWGQG

SEQ ID NO: 180 - protein, 20 aa, Homo sapiens
ARTAHYGSLPQKSHGRTQDE

SEQ ID NO: 181 - protein, 15 aa, Human herpesvirus
ARVAEHPDARLAWAR

SEQ ID NO: 182 - protein, 15 aa, Homo sapiens
ASDLEKIHLDEKSFR

SEQ ID NO: 183 - protein, 20 aa, Homo sapiens
ASGGTFSSFAINWVRQAPGQ

SEQ ID NO: 184 - protein, 19 aa, Homo sapiens
CFYQKKEEDWICCACQKTR

SEQ ID NO: 185 - protein, 15 aa, Homo sapiens
DATTNPSLILAAAQM

SEQ ID NO: 186 - protein, 15 aa, Homo sapiens
DFLTISPKLLGELLQ

SEQ ID NO: 187 - protein, 20 aa, Homo sapiens
DHARHGFLPRHRDTGILDSI

SEQ ID NO: 188 - protein, 15 aa, Homo sapiens
DPGVKSVTKIYNYYK

SEQ ID NO: 189 - protein, 15 aa, Homo sapiens
DQMAVEKLSDGIRKF

SEQ ID NO: 190 - protein, 23 aa, Homo sapiens
DRFSGSKSVSTASLTISGLQAED

SEQ ID NO: 191 - protein, 19 aa, Homo sapiens
DRKYSICKSGCFYQKKEED

SEQ ID NO: 192 - protein, 17 aa, Homo sapiens
DSYTLTEELAYAEIRVK

SEQ ID NO: 193 - protein, 20 aa, Homo sapiens
DYKSAHKGFKGVDAQGTLSK

SEQ ID NO: 194 - protein, 15 aa, Homo sapiens
EAGISKDRILIKLSS

SEQ ID NO: 195 - protein, 21 aa, Homo sapiens
EDTAVYYCARNSGYSISRDVY

SEQ ID NO: 196 - protein, 15 aa, Homo sapiens
EKSFRWLHNEDQMAV

SEQ ID NO: 197 - protein, 17 aa, Homo sapiens
ENLHRTFDPHFLRVPCW

SEQ ID NO: 198 - protein, 20 aa, Homo sapiens
ENPVVHFFKNIVTPRTPPPS

SEQ ID NO: 199 - protein, 22 aa, Homo sapiens
EWMGGIIPIFGAADYAQKFQGR

SEQ ID NO: 200 - protein, 15 aa, Homo sapiens
FDPHFLRVPCWKITL

SEQ ID NO: 201 - protein, 15 aa, Homo sapiens
FGAEILKKIPGRVST

SEQ ID NO: 202 - protein, 15 aa, Homo sapiens
FHAIDEYKPQDATTN

SEQ ID NO: 203 - protein, 15 aa, Measles virus
FIVLSIAYPTLSEIK

SEQ ID NO: 204 - protein, 20 aa, Homo sapiens
FKGVDAQGTLSKIFKLGGRD

SEQ ID NO: 205 - protein, 15 aa, Homo sapiens
FTTVVADTGDFHAID

SEQ ID NO: 206 - protein, 15 aa, Homo sapiens
GELLQDNAKLVPVLS

SEQ ID NO: 207 - protein, 21 aa, Homo sapiens
GFTFSDYYMNWIRQAPGKGLE

SEQ ID NO: 208 - protein, 21 aa, Homo sapiens
GHWGAWMPSSISAFEGTCVSI

SEQ ID NO: 209 - protein, 15 aa, Homo sapiens
GIHCNMTLLFSFAQA

SEQ ID NO: 210 - protein, 15 aa, Human immunodeficiency virus
GIKQLQARVLAVERY

SEQ ID NO: 211 - protein, 15 aa, Homo sapiens
GIRKFAADAVKLERM

SEQ ID NO: 212 - protein, 22 aa, Homo sapiens
GNAKNSLYLQMHSLRAEDTAVY

SEQ ID NO: 213 - protein, 20 aa, Homo sapiens
GRFFGGDRGAPKRGSGKDSH

SEQ ID NO: 214 - protein, 15 aa, Homo sapiens
GRILDWHVANTDKKS

SEQ ID NO: 215 - protein, 15 aa, Homo sapiens
GRVSTEVDARLSFDK

SEQ ID NO: 216 - protein, 20 aa, Homo sapiens
GVDAQGTLSKIFKLGGRDSR

SEQ ID NO: 217 - protein, 19 aa, Homo sapiens
HFSIHCCPPFTFLNSKKEI

SEQ ID NO: 218 - protein, 20 aa, Homo sapiens
HRDTGILDSIGRFFGGDRGA

SEQ ID NO: 219 - protein, 15 aa, Homo sapiens
IKLSSTWEGIQAGKE

SEQ ID NO: 220 - protein, 20 aa, Homo sapiens
IVTPRTPPPSQGKGRGLSLS

SEQ ID NO: 221 - protein, 18 aa, Homo sapiens
KIFKLGGRDSRSGSPMAR

SEQ ID NO: 222 - protein, 16 aa, Homo sapiens
KLERMLTERMFNAENG

SEQ ID NO: 223 - protein, 15 aa, Homo sapiens
KLGGSQEDQIKNAID

SEQ ID NO: 224 - protein, 15 aa, Homo sapiens
KNAIDKLFVLFGAEI

SEQ ID NO: 225 - protein, 15 aa, Homo sapiens
LSFDKDAMVARARRL

SEQ ID NO: 226 - protein, 20 aa, Homo sapiens
LSRFSWGAEGQRPGFGYGGR

SEQ ID NO: 227 - protein, 20 aa, Homo sapiens
LSYSHSDYDLGKRPTKDSYT

SEQ ID NO: 228 - protein, 15 aa, Homo sapiens
LVEEAIAYGRKLGGS

SEQ ID NO: 229 - protein, 26 aa, Homo sapiens
LVGDEVELPCRISPGKNATGMEVGWY

SEQ ID NO: 230 - protein, 25 aa, Homo sapiens
LYRNGKDQDGDQAPEYRGRTELLKD

SEQ ID NO: 231 - protein, 20 aa, Homo sapiens
MASQKRPSQRHGSKYLATAS

SEQ ID NO: 232 - protein, 15 aa, Homo sapiens
MESALDQLKQFTTVV

SEQ ID NO: 233 - protein, 19 aa, Homo sapiens
MSQKPAKEGPRLSKNQKYS

SEQ ID NO: 234 - protein, 15 aa, Homo sapiens
MSSSPVKRQRMESAL

SEQ ID NO: 235 - protein, 15 aa, Human herpesvirus
NPVMERFAAHAGDLV

SEQ ID NO: 236 - protein, 20 aa, Homo sapiens
NSGYSISRDVYWGQGTLVTV

SEQ ID NO: 237 - protein, 23 aa, Homo sapiens
PCRFDFPDELRPAVVHGVHYFNS

SEQ ID NO: 238 - protein, 20 aa, Homo sapiens
PGFGYGGRASDYKSAHKGFK

SEQ ID NO: 239 - protein, 23 aa, Homo sapiens
PPFTFLNSKKEIVDRKYSICKSG

SEQ ID NO: 240 - protein, 20 aa, Homo sapiens
PQKSHGRTQDENPVVHFFKN

SEQ ID NO: 241 - protein, 25 aa, Homo sapiens
PRPEVRPPPAKQRPPQKSKQQPRSS

SEQ ID NO: 242 - protein, 15 aa, Homo sapiens
QAGKELEEQHGIHCN

SEQ ID NO: 243 - protein, 11 aa, Homo sapiens
QFQLVESGGGL

SEQ ID NO: 244 - protein, 22 aa, Homo sapiens
QKYSEHFSIHCCPPFTFLNSKK

SEQ ID NO: 245 - protein, 24 aa, Homo sapiens
QPRSSPLRGPGASRGGSPVKASRF

SEQ ID NO: 246 - protein, 24 aa, Homo sapiens
QQHPGKAPKVMIYDVTKRPSGVPD

SEQ ID NO: 247 - protein, 23 aa, Homo sapiens
QRPPQKSKQQPRSSPLRGPGASR

SEQ ID NO: 248 - protein, 12 aa, Homo sapiens
QSVLTQPRSVSG

SEQ ID NO: 249 - protein, 13 aa, Homo sapiens
QSVLTQSPSASAS

SEQ ID NO: 250 - protein, 20 aa, Homo sapiens
QTWGTGIETVFGGGTKVTVL

SEQ ID NO: 251 - protein, 21 aa, Homo sapiens
RAEDTAVYYCARRKVAMATTY

SEQ ID NO: 252 - protein, 15 aa, Homo sapiens
RARRLIELYKEAGIS

SEQ ID NO: 253 - protein, 20 aa, Homo sapiens
RFSWGAEGQRPGFGYGGRAS

SEQ ID NO: 254 - protein, 20 aa, Homo sapiens
RGSGKDSHHPARTAHYGSLP

SEQ ID NO: 255 - protein, 19 aa, Homo sapiens
RLSKNQKYSEHFSIHCCPP

SEQ ID NO: 256 - protein, 19 aa, Homo sapiens
RPGFGYGGRASDYKSAHKG

SEQ ID NO: 257 - protein, 15 aa, Homo sapiens
SFAQAVACAEAGVTL

SEQ ID NO: 258 - protein, 24 aa, Homo sapiens
SGCFYQKKEEDWICCACQKTRTSR

SEQ ID NO: 259 - protein, 20 aa, Homo sapiens
SKYLATASTMDHARHGFLPR

SEQ ID NO: 260 - protein, 20 aa, Homo sapiens
SQRHGSKYLATASTMDHARH

SEQ ID NO: 261 - protein, 20 aa, Homo sapiens
SVKGRFTISRGNAKNSLYLQ

SEQ ID NO: 262 - protein, 19 aa, Homo sapiens
SYAGGSACVFGTGTKLTVL

SEQ ID NO: 263 - protein, 15 aa, Homo sapiens
TDKKSYEPLEDPGVK

SEQ ID NO: 264 - protein, 19 aa, Homo sapiens
TFLNSKKEIVDRKYSICKS

SEQ ID NO: 265 - protein, 15 aa, Homo sapiens
TGEIKALAGCDFLTI

SEQ ID NO: 266 - protein, 15 aa, Homo sapiens
TIVMGASFRNTGEIK

SEQ ID NO: 267 - protein, 20 aa, Homo sapiens
VIVEMNSSVEAIEGSHVSLL

SEQ ID NO: 268 - protein, 15 aa, Human herpesvirus
VPVLAFDAARLRLLE

SEQ ID NO: 269 - protein, 15 aa, Homo sapiens
VPVLSAKAAQASDLE

SEQ ID NO: 270 - protein, 20 aa, unidentified
  REGION 1..20: note = epitope involved in multiple sclerosis
YDENPVVHFFKNIVTPRTPP

SEQ ID NO: 271 - protein, 15 aa, Homo sapiens
YNYYKKFSYKTIVMG

SEQ ID NO: 272 - protein, 15 aa, Homo sapiens
ARTAHYGSLPQKSHG

SEQ ID NO: 273 - protein, 20 aa, Cavia porcellus
ASQKRPSQRHGSKYLATAST

SEQ ID NO: 274 - protein, 38 aa, Homo sapiens
ASQKRPSQRHGSKYLATASTMDHARHGFLPRHRDTGIL

SEQ ID NO: 275 - protein, 17 aa, Human herpesvirus
DAYPCYFFKSACRPRAP

SEQ ID NO: 276 - protein, 17 aa, Homo sapiens
DENPVVHFFKNIVTPRT

SEQ ID NO: 277 - protein, 8 aa, unidentified
  REGION 1..8: note = epitope involved in multiple sclerosis
EAGAGGGA

SEQ ID NO: 278 - protein, 12 aa, Bos taurus
EDKGACLLPKIE

SEQ ID NO: 279 - protein, 15 aa, unidentified
  REGION 1..15: note = epitope involved in multiple sclerosis
ENPKVHFFKNIVTPR

SEQ ID NO: 280 - protein, 8 aa, unidentified
  REGION 1..8: note = epitope involved in multiple sclerosis
EPARSRSR

SEQ ID NO: 281 - protein, 15 aa, unidentified
  REGION 1..15: note = epitope involved in multiple sclerosis
EPMTPHQWITLYRSY

SEQ ID NO: 282 - protein, 15 aa, unidentified
  REGION 1..15: note = epitope involved in multiple sclerosis
FCPPILPYSAWCPVP

SEQ ID NO: 283 - protein, 20 aa, Mus musculus
GFGYGGRASDYKSAHKGFKG

SEQ ID NO: 284 - protein, 12 aa, Homo sapiens
GKWLGHPDKFVG

SEQ ID NO: 285 - protein, 19 aa, Homo sapiens
GSKYLATASTMDHARHGFL

SEQ ID NO: 286 - protein, 20 aa, Homo sapiens
GSKYLATASTMDHARHGFLP

SEQ ID NO: 287 - protein, 15 aa, Homo sapiens
HHPARTAHYGSLPQK

SEQ ID NO: 288 - protein, 22 aa, Homo sapiens
HHPARTAHYGSLPQKSHGRTQD

SEQ ID NO: 289 - protein, 15 aa, Human papillomavirus
IGGRVHFFKDISPIA

SEQ ID NO: 290 - protein, 11 aa, Homo sapiens
KLSDGIRKFAA

SEQ ID NO: 291 - protein, 16 aa, Homo sapiens
KNIVTPRTPPPSQGKG

SEQ ID NO: 292 - protein, 21 aa, Homo sapiens
KSHGRTQDENPVVHFFKNIVT

SEQ ID NO: 293 - protein, 21 aa, Homo sapiens
KSHGRTQDQDPVVHFFKNIVT

SEQ ID NO: 294 - protein, 9 aa, Homo sapiens
LLFSFAQAV

SEQ ID NO: 295 - protein, 20 aa, Cavia porcellus
MDHARHGFLPRHRDTGILDS

SEQ ID NO: 296 - protein, 15 aa, unidentified
  REGION 1..15: note = epitope involved in multiple sclerosis
MPVSRLCIELDWCPP

SEQ ID NO: 297 - protein, 20 aa, Homo sapiens
PSQGKGRGLSLSRFSWGAEG

SEQ ID NO: 298 - protein, 15 aa, unidentified
  REGION 1..15: note = epitope involved in multiple sclerosis
RGTQEWTELWVSFRA

SEQ ID NO: 299 - protein, 16 aa, Homo sapiens
SHHPARTAHYGSLPQK

SEQ ID NO: 300 - protein, 15 aa, unidentified
  REGION 1..15: note = epitope involved in multiple sclerosis
SRGSHEWAVLFRFYY

SEQ ID NO: 301 - protein, 15 aa, unidentified
  REGION 1..15: note = epitope involved in multiple sclerosis
SSAKSHCYAFCSGLP

SEQ ID NO: 302 - protein, 12 aa, Homo sapiens
TCFFRDHSYQEE

SEQ ID NO: 303 - protein, 10 aa, Homo sapiens
TQDENPVVHF

SEQ ID NO: 304 - protein, 18 aa, Homo sapiens
TQDQDPVVHFFKNIVTPR

SEQ ID NO: 305 - protein, 12 aa, Bos taurus
TSVFDKLKHLVD

SEQ ID NO: 306 - protein, 21 aa, Mus musculus
VHFFKNIVTPRTPPPSQGKGR

SEQ ID NO: 307 - protein, 10 aa, Homo sapiens
VVHFFKNIVT

SEQ ID NO: 308 - protein, 15 aa, Homo sapiens
YGSLPQKSHGRTQDQ

SEQ ID NO: 309 - protein, 17 aa, Homo sapiens
YKDSHHPARTAHYGSLP

SEQ ID NO: 310 - protein, 9 aa, Homo sapiens
DYKSAHKGF

SEQ ID NO: 311 - protein, 15 aa, Homo sapiens
GKDSHHPARTAHYGS

SEQ ID NO: 312 - protein, 9 aa, Homo sapiens
KYLATASTM

SEQ ID NO: 313 - protein, 21 aa, Homo sapiens
DENPVVHFFKNIVTPRTPPPS

SEQ ID NO: 314 - protein, 12 aa, Homo sapiens
FFKNIVTPRTPP

SEQ ID NO: 315 - protein, 21 aa, Homo sapiens
TGGQKGRGSRGQHQAHSLERV

SEQ ID NO: 316 - protein, 18 aa, Homo sapiens
YKTTICGKGLSATVTGGQ

SEQ ID NO: 317 - protein, 20 aa, Homo sapiens
GLSLSRFSWGAEGQRPGFGY

SEQ ID NO: 318 - protein, 19 aa, Homo sapiens
APKRGSGKDSHHAARTAHY

SEQ ID NO: 319 - protein, 23 aa, Homo sapiens
DAIGEGKVTLRIRNVRFSDEGGF

SEQ ID NO: 320 - protein, 21 aa, Homo sapiens
DSIGRFFGGDRGAPKRGSGKD

SEQ ID NO: 321 - protein, 20 aa, Homo sapiens
ELPCRISPGKNATGMEVGWY

SEQ ID NO: 322 - protein, 23 aa, Homo sapiens
EYRGRTELLKDAIGEGKVTLRIR

SEQ ID NO: 323 - protein, 20 aa, Homo sapiens
FSWGAEGQRPGFGYGGRASD

SEQ ID NO: 324 - protein, 22 aa, Homo sapiens
GGQKGRGSRGQHQAHSLERVCH

SEQ ID NO: 325 - protein, 15 aa, Herpes simplex virus
GGRRLFFVKAHVRES

SEQ ID NO: 326 - protein, 20 aa, Homo sapiens
GKGRGLSLSRFSWGAEGQRP

SEQ ID NO: 327 - protein, 24 aa, Homo sapiens
GLSLSRFSWGAEGQRPGFGYGGRA

SEQ ID NO: 328 - protein, 23 aa, Homo sapiens
GMEVGWYRPPFSRVVHLYRNGKD

SEQ ID NO: 329 - protein, 22 aa, Homo sapiens
GQFRVIGPRHPIRALVGDEVEL

SEQ ID NO: 330 - protein, 15 aa, Homo sapiens
GTLSKIFKLGGRDSR

SEQ ID NO: 331 - protein, 26 aa, Homo sapiens
GVDAQGTLSKIFKLGGRDSRSGSPMA

SEQ ID NO: 332 - protein, 19 aa, Homo sapiens
HAARTAHYGSLPQKSQGHR

SEQ ID NO: 333 - protein, 17 aa, Homo sapiens
HCLGKWLGHPDKFVGIT

SEQ ID NO: 334 - protein, 15 aa, Homo sapiens
LGHPDKFVGITYALT

SEQ ID NO: 335 - protein, 20 aa, Homo sapiens
LGQGPEFLTYFQNEAQLEKS

SEQ ID NO: 336 - protein, 20 aa, Homo sapiens
LLAEGFYTTGAVRQIFGDYK

SEQ ID NO: 337 - protein, 19 aa, Homo sapiens
NPVVHFFKNIVTPRTPPPS

SEQ ID NO: 338 - protein, 20 aa, Homo sapiens
PQDENPVVHFFKNIVTPRTP

SEQ ID NO: 339 - protein, 20 aa, Homo sapiens
PRHRDTGILDSIGRFFGGDR

SEQ ID NO: 340 - protein, 19 aa, unidentified
  REGION 1..19: note = epitope involved in multiple sclerosis
QAHSLERVSHSLGKWLGHP

SEQ ID NO: 341 - protein, 20 aa, Homo sapiens
RDTGILDSIGRFFGGDRGAP

SEQ ID NO: 342 - protein, 20 aa, Homo sapiens
RFFGGDRGAPKRGSGKDSHH

SEQ ID NO: 343 - protein, 20 aa, Homo sapiens
RTAHYGSLPQKSHGRTQDEN

SEQ ID NO: 344 - protein, 20 aa, Homo sapiens
YKSAHKGFKGVDAQGTLSKI

SEQ ID NO: 345 - protein, 25 aa, Homo sapiens
AARTTHYGSLPQKSQRSQDQNPVHF

SEQ ID NO: 346 - protein, 25 aa, Bos taurus
AEYRGRVSLVEDHIAEGSVAVRIQE

SEQ ID NO: 347 - protein, 17 aa, unidentified
  REGION 1..17: note = epitope involved in multiple sclerosis
AKPVVHLFANIVTPRTP

SEQ ID NO: 348 - protein, 26 aa, Bos taurus
APFDVIGPQEPILAVVGEDAELPCRL

SEQ ID NO: 349 - protein, 11 aa, Homo sapiens
ASDYKSAHKGF

SEQ ID NO: 350 - protein, 19 aa, Homo sapiens
ASQKRPSQRHGKYLATAST

SEQ ID NO: 351 - protein, 20 aa, Mus musculus
ASQKRPSQRSKYLATASTMD

SEQ ID NO: 352 - protein, 26 aa, Bos taurus
AVVGEDAELPCRLSPNVSAKGMELRW

SEQ ID NO: 353 - protein, 11 aa, Homo sapiens
DENPVVHFFKN

SEQ ID NO: 354 - protein, 17 aa, Homo sapiens
ENPVVHEFKNIVTPRTP

SEQ ID NO: 355 - protein, 14 aa, Homo sapiens
ENPVVHFFKNIVTP

SEQ ID NO: 356 - protein, 15 aa, unidentified
  REGION 1..15: note = epitope involved in multiple sclerosis
ENPVVHFFLNIVTPR

SEQ ID NO: 357 - protein, 15 aa, unidentified
  REGION 1..15: note = epitope involved in multiple sclerosis
ENPVVHFFRNIVTPR

SEQ ID NO: 358 - protein, 19 aa, Homo sapiens
GLSLSRFSWGAQGQKPGFG

SEQ ID NO: 359 - protein, 23 aa, Homo sapiens
GTLSKIFKLGGRDSRSGSPMARR

SEQ ID NO: 360 - protein, 25 aa, Bos taurus
IAEGSVAVRIQEVKASDDGEYRCFF

SEQ ID NO: 361 - protein, 25 aa, Bos taurus
KASDDGEYRCFFRQDENYEEAIVHL

SEQ ID NO: 362 - protein, 22 aa, Homo sapiens
KSHGRTQDENPVVHFFKNIVTP

SEQ ID NO: 363 - protein, 17 aa, Homo sapiens
LATASTMDHARHGFLPR

SEQ ID NO: 364 - protein, 14 aa, Homo sapiens
NPVVHFFKNIVTPR

SEQ ID NO: 365 - protein, 19 aa, Homo sapiens
QDENPVVHFFKNIVTPRTP

SEQ ID NO: 366 - protein, 20 aa, Bos taurus
RQDENYEEAIVHLKVAALGS

SEQ ID NO: 367 - protein, 23 aa, Bos taurus
RWFREKVSPAVFVSREGQEQEGE

SEQ ID NO: 368 - protein, 24 aa, Bos taurus
SPNVSAKGMELRWFREKVSPAVFV

SEQ ID NO: 369 - protein, 18 aa, Bos taurus
TLSKIFKLGGRDSRSGSP

SEQ ID NO: 370 - protein, 13 aa, Homo sapiens
VHFFKNIVTPRTE

SEQ ID NO: 371 - protein, 24 aa, Bos taurus
VSREGQEQEGEMAEYRGRVSLVED

SEQ ID NO: 372 - protein, 23 aa, Homo sapiens
VTPRTPPPSQGKGRGLSLSRFSW

SEQ ID NO: 373 - protein, 18 aa, Homo sapiens
ALGQGPQFIFQYYEEEER

SEQ ID NO: 374 - protein, 19 aa, Homo sapiens
GLSLSRFSWGAEGQRPGFG

SEQ ID NO: 375 - protein, 19 aa, Homo sapiens
GLSLSRFSWGAEGQRPGFG

SEQ ID NO: 376 - protein, 14 aa, Homo sapiens
HKGFKGVDAQGTLS

SEQ ID NO: 377 - protein, 24 aa, Homo sapiens
KSHGRTQDENPVVHFFKNIVTPRT

SEQ ID NO: 378 - protein, 21 aa, Homo sapiens
LGQGPEFLIYFQGTGAADDSG

SEQ ID NO: 379 - protein, 20 aa, Homo sapiens
LLKDAIGEGKVTLRIRNVRF

SEQ ID NO: 380 - protein, 20 aa, Homo sapiens
QAPEYRGRTELLKDAIGEGK

SEQ ID NO: 381 - protein, 20 aa, Homo sapiens
RDHSYQEEAAMELKVEDPFY

SEQ ID NO: 382 - protein, 20 aa, Homo sapiens
RPPFSRVVHLYRNGKDQDGD

SEQ ID NO: 383 - protein, 20 aa, Homo sapiens
SDEGGFTCFFRDHSYQEEAA

SEQ ID NO: 384 - protein, 20 aa, Homo sapiens
SKIFKLGGRDSRSGSPMARR

SEQ ID NO: 385 - protein, 19 aa, Homo sapiens
SRGQHQAHSLERVCHCLGK

SEQ ID NO: 386 - protein, 20 aa, Homo sapiens
VTLRIRNVRFSDEGGFTCFF

SEQ ID NO: 387 - protein, 20 aa, Homo sapiens
YRNGKDQDGDQAPEYRGRTE

SEQ ID NO: 388 - protein, 9 aa, Homo sapiens
LMWAKIGPV

SEQ ID NO: 389 - protein, 9 aa, Homo sapiens
SLLLELEEV

SEQ ID NO: 390 - protein, 9 aa, Homo sapiens
VLFSSDFRI

SEQ ID NO: 391 - protein, 12 aa, Homo sapiens
APEYRGRTELLK

SEQ ID NO: 392 - protein, 12 aa, Homo sapiens
ATGMEVGWYRPP

SEQ ID NO: 393 - protein, 12 aa, Homo sapiens
DEGGFTCFFRDH

SEQ ID NO: 394 - protein, 12 aa, Homo sapiens
DHSYQEEAAMEL

SEQ ID NO: 395 - protein, 12 aa, Homo sapiens
DPFYWVSPGVLV

SEQ ID NO: 396 - protein, 12 aa, Homo sapiens
EEAAMELKVEDP

SEQ ID NO: 397 - protein, 12 aa, Homo sapiens
ELKVEDPFYWVS

SEQ ID NO: 398 - protein, 12 aa, Homo sapiens
GDEVELPCRISP

SEQ ID NO: 399 - protein, 12 aa, Homo sapiens
GEGKVTLRIRNV

SEQ ID NO: 400 - protein, 12 aa, Homo sapiens
GPRHPIRALVGD

SEQ ID NO: 401 - protein, 12 aa, Homo sapiens
GRTELLKDAIGE

SEQ ID NO: 402 - protein, 12 aa, Homo sapiens
IRALVGDEVELP

SEQ ID NO: 403 - protein, 19 aa, Homo sapiens
KNIVTPRTPPPSQGKGRGL

SEQ ID NO: 404 - protein, 12 aa, Homo sapiens
LKDAIGEGKVTL

SEQ ID NO: 405 - protein, 12 aa, Homo sapiens
LPCRISPGKNAT

SEQ ID NO: 406 - protein, 19 aa, Homo sapiens
MDHARHGFLPRHRDTGILD

SEQ ID NO: 407 - protein, 12 aa, Homo sapiens
NVRFSDEGGFTC

SEQ ID NO: 408 - protein, 12 aa, Homo sapiens
PPFSRVVHLYRN

SEQ ID NO: 409 - protein, 19 aa, Homo sapiens
PSQGKGRGLSLSRFSWGAE

SEQ ID NO: 410 - protein, 12 aa, Homo sapiens
QDGDQAPEYRGR

SEQ ID NO: 411 - protein, 12 aa, Homo sapiens
QFRVIGPRHPIR

SEQ ID NO: 412 - protein, 19 aa, Homo sapiens
QRPGFGYGGRASDYKSAHK

SEQ ID NO: 413 - protein, 12 aa, Homo sapiens
RNGKDQDGDQAP

SEQ ID NO: 414 - protein, 19 aa, Homo sapiens
SKIFKLGGRDSRSGSPMAR

SEQ ID NO: 415 - protein, 19 aa, Homo sapiens
SLPQKSHGRTQDENPVVHF

SEQ ID NO: 416 - protein, 12 aa, Homo sapiens
SPGKNATGMEVG

SEQ ID NO: 417 - protein, 12 aa, Homo sapiens
SSYAGQFRVIGP

SEQ ID NO: 418 - protein, 9 aa, Homo sapiens
SWGAEGQRP

SEQ ID NO: 419 - protein, 10 aa, Homo sapiens
SWGAEGQRPG

SEQ ID NO: 420 - protein, 12 aa, Homo sapiens
TLRIRNVRFSDE

SEQ ID NO: 421 - protein, 12 aa, Homo sapiens
VGWYRPPFSRVV

SEQ ID NO: 422 - protein, 12 aa, Homo sapiens
VVHLYRNGKDQD

SEQ ID NO: 423 - protein, 8 aa, Homo sapiens
WGAEGQRP

SEQ ID NO: 424 - protein, 10 aa, Homo sapiens
WGAEGQRPGF

SEQ ID NO: 425 - protein, 5 aa, Homo sapiens
AAMEL

SEQ ID NO: 426 - protein, 5 aa, Homo sapiens
ADARM

SEQ ID NO: 427 - protein, 5 aa, Homo sapiens
AHRET

SEQ ID NO: 428 - protein, 15 aa, Bacillus subtilis
ALAVLHFYPDKGAKN

SEQ ID NO: 429 - protein, 21 aa, unidentified [sequence omitted]

SEQ ID NO: 430 - protein, 21 aa, Homo sapiens
ALGQGPQFIFQYYEEEERQRG

SEQ ID NO: 431 - protein, 21 aa, Homo sapiens
ASTMDHARHGFLPRHRDTGIL

SEQ ID NO: 432 - protein, 15 aa, unidentified
  REGION 1..15: note = epitope involved in multiple sclerosis
DFARVHFIRALHGSG

SEQ ID NO: 433 - protein, 15 aa, Haemophilus influenzae
DFARVHFISALHGSG

SEQ ID NO: 434 - protein, 21 aa, Homo sapiens
DPGHGLRLIHYSYGVKDTDKG

SEQ ID NO: 435 - protein, 21 aa, Homo sapiens
DPGLGLRLIYFSYDVKMKEKG

SEQ ID NO: 436 - protein, 20 aa, Homo sapiens
GNFPDRFSGHQFPNYSSELN

SEQ ID NO: 437 - protein, 19 aa, Homo sapiens
GQGPQFIFQYYEEEERQRG

SEQ ID NO: 438 - protein, 15 aa, Homo sapiens
GRASDYKSAHKGFKG

SEQ ID NO: 439 - protein, 18 aa, Cavia porcellus
GTLSKIFKLGGRDSRSGS

SEQ ID NO: 440 - protein, 5 aa, Homo sapiens
HRTFE

SEQ ID NO: 441 - protein, 5 aa, Homo sapiens
HSYQE

SEQ ID NO: 442 - protein, 6 aa, Homo sapiens
KTGQFL

SEQ ID NO: 443 - protein, 21 aa, Homo sapiens
KTRGQQVTLRCSPKSGHDTVS

SEQ ID NO: 444 - protein, 20 aa, Homo sapiens
LVKRTGEKVFLECVQDMDHE

SEQ ID NO: 445 - protein, 16 aa, Homo sapiens
NALLLGDSALYLCASS

SEQ ID NO: 446 - protein, 24 aa, Cavia porcellus
PARTAHYGSLPQKSGRSQDENPVV

SEQ ID NO: 447 - protein, 18 aa, Homo sapiens
PKSGHDTVSWYQQALGQG

SEQ ID NO: 448 - protein, 19 aa, Homo sapiens
PNYSSELNVNALLLGDSAL

SEQ ID NO: 449 - protein, 40 aa, Homo sapiens
PSQGKGRGLSLSRFSWGAEGQRPGFGYGGRASDYKSAHKG

SEQ ID NO: 450 - protein, 5 aa, Homo sapiens
QAPEY

SEQ ID NO: 451 - protein, 15 aa, Mycobacterium avium
QRCRVHFLRNVLAQV

SEQ ID NO: 452 - protein, 15 aa, Mycobacterium tuberculosis
QRCRVHFMRNLYTAV

SEQ ID NO: 453 - protein, 19 aa, Homo sapiens
QYYEEEERQRGNFPDRFSG

SEQ ID NO: 454 - protein, 16 aa, Homo sapiens
SHGRTQDENPVVHFFK

SEQ ID NO: 455 - protein, 20 aa, Homo sapiens
SKIFKLGGRDSRSGSPMARR

SEQ ID NO: 456 - protein, 21 aa, Homo sapiens
SKKFLKIMFSYNNKELIINET

SEQ ID NO: 457 - protein, 19 aa, Cavia porcellus
SLSRFSWGAEGQKPGFGYG

SEQ ID NO: 458 - protein, 17 aa, Homo sapiens
SWGAEGQRPGFGYGGRA

SEQ ID NO: 459 - protein, 20 aa, Homo sapiens
SWYQQALGQGPQFIFQYYEE

SEQ ID NO: 460 - protein, 22 aa, Homo sapiens
TSGVTQSPHTLIKTRGQQVTLR

SEQ ID NO: 461 - protein, 15 aa, Staphylococcus aureus
VLARLHFYRNDVHKE

SEQ ID NO: 462 - protein, 5 aa, Homo sapiens
VTLRI

SEQ ID NO: 463 - protein, 20 aa, unidentified
  REGION 1..20: note = epitope involved in multiple sclerosis
YDENPVVHFFKNIVTPRTPP

SEQ ID NO: 464 - protein, 15 aa, Influenza A virus
YRNLVWFIKKNTRYP

SEQ ID NO: 465 - protein, 20 aa, Homo sapiens
APKRGSGKDSHHPARTAHYG

SEQ ID NO: 466 - protein, 20 aa, Homo sapiens
ASDYKSAHKGFKGVDAQGTL

SEQ ID NO: 467 - protein, 23 aa, Homo sapiens
ATASTMDHARHGFLPRHRDTGIL

SEQ ID NO: 468 - protein, 45 aa, Homo sapiens
FGGDRGAPKRGSGKDSHHPARTAHYGSLPQKSHGRTQDENPVVHF

SEQ ID NO: 469 - protein, 19 aa, Homo sapiens
GAPKRGSGKDSHHPARTAH

SEQ ID NO: 470 - protein, 18 aa, Homo sapiens
GFGYGGRASDYKSAHKGF

SEQ ID NO: 471 - protein, 15 aa, Homo sapiens
HKGFKGVDAQGTLSK

SEQ ID NO: 472 - protein, 20 aa, Homo sapiens
IGRFFGGDRGAPKRGSGKDS

SEQ ID NO: 473 - protein, 12 aa, Cavia porcellus
IVTPRTPPPSQG

SEQ ID NO: 474 - protein, 20 aa, Homo sapiens
LCNMYKKDSHHPARTAHYGS

SEQ ID NO: 475 - protein, 21 aa, Homo sapiens
LDSIGRFFGGDRGAPKRGSGK

SEQ ID NO: 476 - protein, 19 aa, Homo sapiens
LGQGPEFLTYFQNEAQLKS

SEQ ID NO: 477 - protein, 20 aa, Homo sapiens
LPSHARSQPGLCNMYKKDSH

SEQ ID NO: 478 - protein, 19 aa, Homo sapiens
PRHRDTGILDSIGRFFGGD

SEQ ID NO: 479 - protein, 20 aa, Homo sapiens
PRTPPPSQGKGAEGQRPGFG

SEQ ID NO: 480 - protein, 20 aa, Homo sapiens
RGAPKRGSGKVPWLKPGRSP

SEQ ID NO: 481 - protein, 20 aa, Homo sapiens
SLPQKSHGRTQDENPVVHFF

SEQ ID NO: 482 - protein, 20 aa, Homo sapiens
TQDENPVVHFFKNIVTPRTP

SEQ ID NO: 483 - protein, 18 aa, Homo sapiens
TQDQDPBBHFFKNIVTPR

SEQ ID NO: 484 - protein, 20 aa, Homo sapiens
VPWLKPGRSPLPSHARSQPG

SEQ ID NO: 485 - protein, 24 aa, Homo sapiens
VTPRTPPPSQGKGRGLSLSRFSWG

SEQ ID NO: 486 - protein, 19 aa, Homo sapiens
APKRGSGKDSHHPARTAHY

SEQ ID NO: 487 - protein, 27 aa, Homo sapiens
ASQKRPSQRHGSKYLATASTMDHARHG

SEQ ID NO: 488 - protein, 13 aa, Homo sapiens
DPVVHFFKNIVTP

SEQ ID NO: 489 - protein, 19 aa, Homo sapiens
EGQRPGFGYGGRASDYKSA

SEQ ID NO: 490 - protein, 19 aa, Homo sapiens
FFKNIVTPRTPPPSQGKGR

SEQ ID NO: 491 - protein, 43 aa, Homo sapiens
FGGDRGAPKRGSGKDSHHPARTAHYGSLPQKSHGRTQDENPVV

SEQ ID NO: 492 - protein, 12 aa, Mus musculus
FKNIVTPRTPPP

SEQ ID NO: 493 - protein, 40 aa, Homo sapiens
GLSLSRFSWGAEGQRPGFGYGGRASDYKSAHKGFKGVDAQ

SEQ ID NO: 494 - protein, 19 aa, Homo sapiens
GRASDYKSAHKGFKGVDAQ

SEQ ID NO: 495 - protein, 17 aa, Homo sapiens
HHPARTAHYGSLPQKSH

SEQ ID NO: 496 - protein, 19 aa, Homo sapiens
IGRFFGGDRGAPKRGSGKD

SEQ ID NO: 497 - protein, 19 aa, Homo sapiens
KGFKGVDAQGTLSKIFKLG

SEQ ID NO: 498 - protein, 24 aa, Homo sapiens
KNIVTPRTPPPSQGKGRGLSLSRF

SEQ ID NO: 499 - protein, 29 aa, Homo sapiens
KRGSGKDSHHPARTAHYGSLPQKSHGRTQ

SEQ ID NO: 500 - protein, 8 aa, Homo sapiens
LGRAGLTY

SEQ ID NO: 501 - protein, 19 aa, Homo sapiens
LSLSRFSWGAEGQRPGFGY

SEQ ID NO: 502 - protein, 18 aa, Homo sapiens
PGFGYGGRASDYKSAHKG

SEQ ID NO: 503 - protein, 19 aa, Homo sapiens
PPPSQGKGRGLSLSRFSWG

SEQ ID NO: 504 - protein, 33 aa, Oryctolagus cuniculus
PPPSQGKGRGTVLSRFSWGAEGQKPGFGYGGRA

SEQ ID NO: 505 - protein, 17 aa, Homo sapiens
QDENPVVHFFKNIVTPR

SEQ ID NO: 506 - protein, 23 aa, Homo sapiens
QDENPVVHFFKNIVTPRTPPPSQ

SEQ ID NO: 507 - protein, 27 aa, Homo sapiens
RASDYKSAHKGFKGVDAQGTLSKIFKL

SEQ ID NO: 508 - protein, 26 aa, Homo sapiens
RFFGGDRGAPKRGSGKDSHHPARTAH

SEQ ID NO: 509 - protein, 26 aa, Homo sapiens
RGLSLSRFSWGAEGQRPGFGYGGRAS

SEQ ID NO: 510 - protein, 30 aa, Homo sapiens
RHGFLPRHRDTGILDSIGRFFGGDRGAPKR

SEQ ID NO: 511 - protein, 19 aa, Homo sapiens
RHRDTGILDSIGRFFGGDR

SEQ ID NO: 512 - protein, 28 aa, Homo sapiens
RTAHYGSLPQKSHGRTQDENPVVHFFKN

SEQ ID NO: 513 - protein, 17 aa, Homo sapiens
SLPQKSHGRTQDENPVV

SEQ ID NO: 514 - protein, 15 aa, Homo sapiens
SSLGRAGLTYEQYFG

SEQ ID NO: 515 - protein, 31 aa, Homo sapiens
TASTMDHARHGFLPRHRDTGILDSIGRFFGG

SEQ ID NO: 516 - protein, 21 aa, Homo sapiens
AHSLERVCHCLGKWLGHPDKF

SEQ ID NO: 517 - protein, 21 aa, Homo sapiens
AVRQIFGDYKTTICGKGLSAT

SEQ ID NO: 518 - protein, 14 aa, Homo sapiens
CNMYKDSHHPARTA

SEQ ID NO: 519 - protein, 20 aa, Homo sapiens
CQSIAFPSKTSASIGSLCAD

SEQ ID NO: 520 - protein, 21 aa, Homo sapiens
DQAPEYRGRTELLKDAIGEGK

SEQ ID NO: 521 - protein, 20 aa, Homo sapiens
EGKVTLRIRNVRFSDEGGFT

SEQ ID NO: 522 - protein, 21 aa, Homo sapiens
ELKVEDPFYWVSPGVLVLLAV

SEQ ID NO: 523 - protein, 21 aa, Homo sapiens
EVELPCRISPGKNATGMEVGW

SEQ ID NO: 524 - protein, 21 aa, Homo sapiens
EYLINVIHAFQYVIYGTASFF

SEQ ID NO: 525 - protein, 21 aa, Homo sapiens
FFGVALFCGCGHEALTGTEKL

SEQ ID NO: 526 - protein, 19 aa, Homo sapiens
FGGDRGAPKRGSGKVPWLK

SEQ ID NO: 527 - protein, 21 aa, Homo sapiens
FKGVDAQGTLSKIFKLGGRDS

SEQ ID NO: 528 - protein, 21 aa, Homo sapiens
FMIAATYNFAVLKLMGRGTKF

SEQ ID NO: 529 - protein, 19 aa, Homo sapiens
FSRVVHLYRNGKDQDGDQA

SEQ ID NO: 530 - protein, 21 aa, Homo sapiens
FSWGAEGQRPGFGYGGRASDY

SEQ ID NO: 531 - protein, 20 aa, Homo sapiens
GAPKRGSGKDSHHPARTAHY

SEQ ID NO: 532 - protein, 21 aa, Homo sapiens
GCGHEALTGTEKLIETYFSKN

SEQ ID NO: 533 - protein, 21 aa, Homo sapiens
GFLPRHRDTGILDSIGRFFGG

SEQ ID NO: 534 - protein, 21 aa, Homo sapiens
GFTCFFRDHSYQEEAAMELKV

SEQ ID NO: 535 - protein, 21 aa, Homo sapiens
GFYTTGAVRQIFGDYKTTICG

SEQ ID NO: 536 - protein, 21 aa, Homo sapiens
GILDSIGRFFGGDRGAPKRGS

SEQ ID NO: 537 - protein, 21 aa, Homo sapiens
GQFRVIGPRHPIRALVGDEVE

SEQ ID NO: 538 - protein, 21 aa, Homo sapiens
GRGSRGQHQAHSLERVCHCLG

SEQ ID NO: 539 - protein, 21 aa, Homo sapiens
GRSPLPSHARSQPGLCNMYKD

SEQ ID NO: 540 - protein, 20 aa, Homo sapiens
GVLPWNAFPGKVCGSNLLSI

SEQ ID NO: 541 - protein, 21 aa, Homo sapiens
HCLGKWLGHPDKFVGITYALT

SEQ ID NO: 542 - protein, 20 aa, Homo sapiens
HGSKYLATASTMDHARHGFL

SEQ ID NO: 543 - protein, 12 aa, Homo sapiens
HHPARTAHYGSL

SEQ ID NO: 544 - protein, 21 aa, Homo sapiens
HPIRALVGDEVELPCRISPGK

SEQ ID NO: 545 - protein, 21 aa, Homo sapiens
ITVGLVFLCLQYRLRGKLRAE

SEQ ID NO: 546 - protein, 21 aa, Homo sapiens
KGRGLSLSRFSWGAEGQRPGF

SEQ ID NO: 547 - protein, 21 aa, Homo sapiens
KTTICGKGLSATVTGGQKGRG

SEQ ID NO: 548 - protein, 22 aa, Homo sapiens
LDSIGRFFGGDRGAPKRGSGKD

SEQ ID NO: 549 - protein, 21 aa, Homo sapiens
LQYRLRGKLRAEIENLHRTFD

SEQ ID NO: 550 - protein, 21 aa, Homo sapiens
LSKIFKLGGRDSRSGSPMARR

SEQ ID NO: 551 - protein, 21 aa, Homo sapiens
LYGALLLAEGFYTTGAVRQIF

SEQ ID NO: 552 - protein, 21 aa, Homo sapiens
MYKDSHHPARTAHYGSLPQKS

SEQ ID NO: 553 - protein, 21 aa, Homo sapiens
PGFGYGGRASDYKSAHKGFKG

SEQ ID NO: 554 - protein, 21 aa, Homo sapiens
PGKNATGMEVGWYRPPFSRVV

SEQ ID NO: 555 - protein, 16 aa, Homo sapiens
PKRGSGKDSHHPARTA

SEQ ID NO: 556 - protein, 16 aa, Homo sapiens
PKRGSGKVPWLKPGRS

SEQ ID NO: 557 - protein, 21 aa, Homo sapiens
PQKSHGRTQDENPVVHFFKNI

SEQ ID NO: 558 - protein, 21 aa, Homo sapiens
PRTPPPSQGKGRGLSLSRFSW

SEQ ID NO: 559 - protein, 21 aa, Homo sapiens
RAEIENLHRTFDPHFLRVPCW

SEQ ID NO: 560 - protein, 21 aa, Homo sapiens
RNVRFSDEGGFTCFFRDHSYQ

SEQ ID NO: 561 - protein, 21 aa, Homo sapiens
SDYKSAHKGFKGVDAQGTLSK

SEQ ID NO: 562 - protein, 21 aa, Homo sapiens
SGKVPWLKPGRSPLPSHARSQ

SEQ ID NO: 563 - protein, 11 aa, Homo sapiens
SIGRFFGGDRG

SEQ ID NO: 564 - protein, 21 aa, Homo sapiens
SLCADARMYGVLPWNAFPGKV

SEQ ID NO: 565 - protein, 20 aa, Homo sapiens
SYQEEAAMELKVEDPFYWVS

SEQ ID NO: 566 - protein, 21 aa, Homo sapiens
TELLKDAIGEGKVTLRIRNVR

SEQ ID NO: 567 - protein, 20 aa, Homo sapiens
TFDPHFLRVPCWKITLFVIV

SEQ ID NO: 568 - protein, 21 aa, Homo sapiens
TPRTPPPSQGKGAEGQRPGFG

SEQ ID NO: 569 - protein, 21 aa, Homo sapiens
VALIICYNWLHRRLAGQFLEE

SEQ ID NO: 570 - protein, 21 aa, Homo sapiens
VFACSAVPVYIYFNTWTTCQS

SEQ ID NO: 571 - protein, 21 aa, Homo sapiens
VIVPVLGPLVALIICYNWLHR

SEQ ID NO: 572 - protein, 21 aa, Homo sapiens
YFSKNYQDYEYLINVIHAFQY

SEQ ID NO: 573 - protein, 21 aa, Homo sapiens
YIYFNTWTTCQSIAFPSKTSA

SEQ ID NO: 574 - protein, 20 aa, Homo sapiens
YNWLHRRLAGQFLEELRNPF

SEQ ID NO: 575 - protein, 21 aa, Homo sapiens
YRNGKDQDGDQAPEYRGRTEL

SEQ ID NO: 576 - protein, 32 aa, Homo sapiens
AAFVGAAATLVSLLTFMIAATYNFAVLKLMGR

SEQ ID NO: 577 - protein, 14 aa, Mus musculus
ACSAVTVYIYFNTW

SEQ ID NO: 578 - protein, 19 aa, Homo sapiens
ASDYKSAHKGFKGVDAQGT

SEQ ID NO: 579 - protein, 20 aa, Homo sapiens
AVRQIFGDYKTTICGKGLSA

SEQ ID NO: 580 - protein, 16 aa, Mus musculus
DYKTTICGKGLSATVT

SEQ ID NO: 581 - protein, 31 aa, Homo sapiens
FGVALFCGCEVEALTGTEKLIETYFSKNYQD

SEQ ID NO: 582 - protein, 19 aa, Homo sapiens
FKGVDAQGTLSKIFKLGGR

SEQ ID NO: 583 - protein, 14 aa, Mus musculus
FSKNYQDYEYLINV

SEQ ID NO: 584 - protein, 19 aa, Homo sapiens
GLRLIHYSVGAGITDQGEV

SEQ ID NO: 585 - protein, 40 aa, Homo sapiens
GSKYLATASTMDHARHGFLPRHRDTGILDSIGRFFGGDRG

SEQ ID NO: 586 - protein, 32 aa, Homo sapiens
GTASFFFLYGALLLAYGFYTTGAVRQIFGDYK

SEQ ID NO: 587 - protein, 19 aa, Homo sapiens
HHPARTAHYGSLPQKSHGR

SEQ ID NO: 588 - protein, 29 aa, Homo sapiens
IGRFFGGDRGAPKRGSGKDSHHPARTAHY

SEQ ID NO: 589 - protein, 32 aa, Homo sapiens
KGRGSRGQHQAHSLERVCHCLGCWLGHPDKFV

SEQ ID NO: 590 - protein, 32 aa, Homo sapiens
KVCGSNLLSICKTAEFQMTFHLFIAAFVGAAA

SEQ ID NO: 591 - protein, 15 aa, Mus musculus
LFIAAFVGAAATLVS

SEQ ID NO: 592 - protein, 32 aa, Homo sapiens
LGHPDKFVGITYALTVVWLLVFACSAVPVYIY

SEQ ID NO: 593 - protein, 31 aa, Homo sapiens
LLECCARCLVGAPFASLVATGLCFFGVALFC

SEQ ID NO: 594 - protein, 35 aa, Mus musculus
PWNAFPGKVCGSNLLSICKTAEFQMTFHLFIAAFV

SEQ ID NO: 595 - protein, 20 aa, Homo sapiens
QDENPVVHFFKNIVTPRTPP

SEQ ID NO: 596 - protein, 31 aa, Homo sapiens
RQIFGDYKTTCGKGLSATVTGGQKGRGSRGQ

SEQ ID NO: 597 - protein, 32 aa, Homo sapiens
SASIGTLCADARMYGVLPWNAFFGKVCGSNLL

SEQ ID NO: 598 - protein, 32 aa, Homo sapiens
SAVPVYIYFNTWTTCQSIAAPCKTSASIGTLC

SEQ ID NO: 599 - protein, 15 aa, Mus musculus
TVTGGQKGRGSRGQH

SEQ ID NO: 600 - protein, 32 aa, Homo sapiens
YFSKNYQDYEYLINVIHAFQYVIYGTASFFFL

SEQ ID NO: 601 - protein, 12 aa, Homo sapiens
PVVHFFKNIVTP

SEQ ID NO: 602 - protein, 9 aa, Homo sapiens
KVEDPFYWV

SEQ ID NO: 603 - protein, 11 aa, Homo sapiens
PTRAPSGPRPP

SEQ ID NO: 604 - protein, 11 aa, Homo sapiens
RRREGPDRSPR

SEQ ID NO: 605 - protein, 15 aa, Human adenovirus
DFEVVTFLKDVLPEF

SEQ ID NO: 606 - protein, 15 aa, Pseudomonas aeruginosa
DRLLMLFAKDVVSRN

SEQ ID NO: 607 - protein, 15 aa, unidentified
  REGION 1..15: note = epitope involved in multiple sclerosis
ENPVVHYFRNIVTPR

SEQ ID NO: 608 - protein, 15 aa, Human herpesvirus
FRQLVHFVRDFAQLL

SEQ ID NO: 609 - protein, 13 aa, Herpes simplex virus
GGRRLFFVKAHVR

SEQ ID NO: 610 - protein, 15 aa, Mammalian orthoreovirus
MARAAFLFKTVGFGG

SEQ ID NO: 611 - protein, 9 aa, Homo sapiens
KLIETYFSK

SEQ ID NO: 612 - protein, 9 aa, Saccharomyces cerevisiae
KLVETYISK

SEQ ID NO: 613 - protein, 21 aa, Homo sapiens
AAGRGLQLLFYSIGIDQISSE

SEQ ID NO: 614 - protein, 21 aa, Homo sapiens
ALGQGPEFLTYFNYEAQPDKS

SEQ ID NO: 615 - protein, 21 aa, Homo sapiens
ALGQGPEFLTYFNYEAQQDKS

SEQ ID NO: 616 - protein, 21 aa, Homo sapiens
ALGQGPEFLTYFQNEAQLDKS

SEQ ID NO: 617 - protein, 21 aa, Homo sapiens
DLGHGLRLIHYSYGVQDTNKG

SEQ ID NO: 618 - protein, 21 aa, Homo sapiens
DLGLGLRLIHYSNTAGTTGKG

SEQ ID NO: 619 - protein, 21 aa, Homo sapiens
DPGEGPVLLIALYKAGELTSN

SEQ ID NO: 620 - protein, 21 aa, Homo sapiens
DPGKGPEFLFTLYSAGEEKEK

SEQ ID NO: 621 - protein, 21 aa, Homo sapiens
DPGKSLESLFVLLSNGAVKQE

SEQ ID NO: 622 - protein, 21 aa, Homo sapiens
DPGMELHLIHYSYGVNSTEKG

SEQ ID NO: 623 - protein, 21 aa, Homo sapiens
DPGMGLKLIYYSVGAGITDKG

SEQ ID NO: 624 - protein, 21 aa, Homo sapiens
DPGMGLRLIHYSVGAGITDQG

SEQ ID NO: 625 - protein, 21 aa, Homo sapiens
DPGMGLRLIHYSVGEGTTAKG

SEQ ID NO: 626 - protein, 21 aa, Homo sapiens
DPGMGLRRIHYSVAAGITDKG

SEQ ID NO: 627 - protein, 21 aa, Homo sapiens
DPGRGPVFLLLIRENEKEKRK

SEQ ID NO: 628 - protein, 21 aa, Homo sapiens
DSKKFLKIMFSYNNKELIINE

SEQ ID NO: 629 - protein, 21 aa, Homo sapiens
DTGRGPVSLTIMTFSENTKSN

SEQ ID NO: 630 - protein, 20 aa, Homo sapiens
EKKAPTFLFMLTSSGIEKKS

SEQ ID NO: 631 - protein, 21 aa, Homo sapiens
ELGKGPQLIIDIRSNVGEKKD

SEQ ID NO: 632 - protein, 21 aa, Homo sapiens
ELGKRPQLIIDIRSNVGEKKD

SEQ ID NO: 633 - protein, 21 aa, Homo sapiens
EPGAGLQLLTYIFSNMDMKQD

SEQ ID NO: 634 - protein, 21 aa, Homo sapiens
EPGEGPVLLVTVVTGGEVKKL

SEQ ID NO: 635 - protein, 21 aa, Homo sapiens
ESGKGPQFIIDIRSNMDKRQG

SEQ ID NO: 636 - protein, 21 aa, Homo sapiens
ETAKTPEALFVMTLNGDEKKK

SEQ ID NO: 637 - protein, 18 aa, Homo sapiens
FPGCAPRLLVKGSKPSQQ

SEQ ID NO: 638 - protein, 21 aa, Homo sapiens
FPGKGPALLIAIRPDVSEKKE

SEQ ID NO: 639 - protein, 22 aa, Homo sapiens
FPKKSLMLMATSNEGSKATYEQ

SEQ ID NO: 640 - protein, 22 aa, Homo sapiens
FPKKSLMQIATSNEGSKATYEQ

SEQ ID NO: 641 - protein, 22 aa, Homo sapiens
FPKQSLMLMATSNEGSKATYEQ

SEQ ID NO: 642 - protein, 19 aa, Homo sapiens
FPSQGPRFIIQGYKTKVTN

SEQ ID NO: 643 - protein, 21 aa, Homo sapiens
GPGQDPQFLISFYEKMQSDKG

SEQ ID NO: 644 - protein, 20 aa, Homo sapiens
HAGEAPTFLSYNVLDGLEEK

SEQ ID NO: 645 - protein, 20 aa, Homo sapiens
HDGGAPTFLSYNGLDGLEET

SEQ ID NO: 646 - protein, 19 aa, Homo sapiens
HPAGAIVSLFMLSSQKKKH

SEQ ID NO: 647 - protein, 22 aa, Homo sapiens
HPNKGLQLLLKYTSAATLVKGI

SEQ ID NO: 648 - protein, 19 aa, Homo sapiens
IHSQGPQYIIHGLKNNETN

SEQ ID NO: 649 - protein, 21 aa, Homo sapiens
ILGQKVEFLVSFYNNEISEKS

SEQ ID NO: 650 - protein, 21 aa, Homo sapiens
KAKKPPELMFVYSYEKLSINE

SEQ ID NO: 651 - protein, 21 aa, Homo sapiens
KHGEAPVFLMILLKGGEQKGH

SEQ ID NO: 652 - protein, 21 aa, Homo sapiens
KHGEAPVFLMILLKGGEQMRR

SEQ ID NO: 653 - protein, 21 aa, Homo sapiens
KLEEELKFLVYFQNEELIQKA

SEQ ID NO: 654 - protein, 21 aa, Homo sapiens
KSSQAPKLLFHYYDKDFNNEA

SEQ ID NO: 655 - protein, 21 aa, Homo sapiens
KSSQAPKLLFHYYNKDFNNEA

SEQ ID NO: 656 - protein, 21 aa, Homo sapiens
KYGEGLIFLMMLQKGGEEKSH

SEQ ID NO: 657 - protein, 19 aa, Homo sapiens
LPSQGPEYVIHGLTSNVNN

SEQ ID NO: 658 - protein, 19 aa, Homo sapiens
NPWGQLINLFYIPSGTKQN

SEQ ID NO: 659 - protein, 21 aa, Homo sapiens
NQNKEFMLLISFQNEQVLQET

SEQ ID NO: 660 - protein, 21 aa, Homo sapiens
NSGRGLVHLILIRSNEREKHS

SEQ ID NO: 661 - protein, 22 aa, Homo sapiens
PPSGELVFLIRRNSFDEQNEIS

SEQ ID NO: 662 - protein, 22 aa, Homo sapiens
PPSRQMILVIRQEAYKQQNATE

SEQ ID NO: 663 - protein, 22 aa, Homo sapiens
PSSGEMIFLIYQGSYDEQNATE

SEQ ID NO: 664 - protein, 21 aa, Homo sapiens
RPGGHPVFLIQLVKSGEVKKQ

SEQ ID NO: 665 - protein, 21 aa, Homo sapiens
SAKKPLELMFVYNFKEQTENN

SEQ ID NO: 666 - protein, 21 aa, Homo sapiens
SAKKPLELMFVYSLEERVENN

SEQ ID NO: 667 - protein, 21 aa, Homo sapiens
SLDQGLQFLIHYYNGEERAKG

SEQ ID NO: 668 - protein, 21 aa, Homo sapiens
SLDQGLQFLIQYYNGEERAKG

SEQ ID NO: 669 - protein, 21 aa, Homo sapiens
TLEEELKFFIYFQNEEIIQKA

SEQ ID NO: 670 - protein, 21 aa, Homo sapiens
TLGQGLQFLFEYFSETQRNKG

SEQ ID NO: 671 - protein, 21 aa, Homo sapiens
TLGQGPEFLTYFQNEAQLEKS

SEQ ID NO: 672 - protein, 16 aa, Homo sapiens
VFLCLQYRLRGKLRAE

SEQ ID NO: 673 - protein, 21 aa, Homo sapiens
VLGQGPQFIFQYYEKEERGRG

SEQ ID NO: 674 - protein, 21 aa, Homo sapiens
VLKNEFKFLVSFQNENVFDET

SEQ ID NO: 675 - protein, 21 aa, Homo sapiens
VMGKEIKFLLHFVKESKQDES

SEQ ID NO: 676 - protein, 21 aa, Homo sapiens
YPAEGPTFLISISSIKDKNED

SEQ ID NO: 677 - protein, 21 aa, Homo sapiens
YPGEGLQLLLKATKADDKGSN

SEQ ID NO: 678 - protein, 22 aa, Homo sapiens
YPNQGLQLLLKYLSGSTLVESI

SEQ ID NO: 679 - protein, 22 aa, Homo sapiens
YPNQGLQLLLKYLSGSTLVKGI

SEQ ID NO: 680 - protein, 22 aa, Homo sapiens
YPNQGLQLLLKYTSAATLVKGI

SEQ ID NO: 681 - protein, 22 aa, Homo sapiens
YPNQGLQLLLKYTSGATLVKGI

SEQ ID NO: 682 - protein, 22 aa, Homo sapiens
YPNQGLQLLLKYTTGATLVKGI

SEQ ID NO: 683 - protein, 22 aa, Homo sapiens
YPNRGLQFLLKYITGDNLVKGS

SEQ ID NO: 684 - protein, 17 aa, Homo sapiens
YPSKPLQLLQRETMENS

SEQ ID NO: 685 - protein, 20 aa, Homo sapiens
YSGKSPELIMFIYSNGDKED

SEQ ID NO: 686 - protein, 18 aa, Homo sapiens
YSRQRLQLLLRHISRESI

SEQ ID NO: 687 - protein, 8 aa, Homo sapiens
ADARMYGV

SEQ ID NO: 688 - protein, 20 aa, Human herpesvirus
DPGEGPSTGPRGQGDGGRRK

SEQ ID NO: 689 - protein, 20 aa, Human herpesvirus
EADYFEYHQEGGPDGEPDVP

SEQ ID NO: 690 - protein, 8 aa, Homo sapiens
EALTGTEK

SEQ ID NO: 691 - protein, 20 aa, Human herpesvirus
GCKGTHGGTGAGAGAGGAGA

SEQ ID NO: 692 - protein, 31 aa, Human herpesvirus
GEADYFEYHQEGGPDGEPDVPPGAIEQGPAD

SEQ ID NO: 693 - protein, 20 aa, Human herpesvirus
GGPDGEPDVPPGAIEQGPAD

SEQ ID NO: 694 - protein, 29 aa, Human herpesvirus
GGPDGEPDVPPGAIEQGPADDPGEGPSTG

SEQ ID NO: 695 - protein, 20 aa, Human herpesvirus
GGRPGAPGGSGSGPRHRDGV

SEQ ID NO: 696 - protein, 20 aa, Human herpesvirus
GNGLGEKGDTSGPEGSGGSG

SEQ ID NO: 697 - protein, 20 aa, Human herpesvirus
GRRPFFHPVGEADYFEYHQE

SEQ ID NO: 698 - protein, 20 aa, Human herpesvirus
GSGPRHRDGVRRPQKRPSCI

SEQ ID NO: 699 - protein, 30 aa, Human herpesvirus
GSGPRHRDGVRRPQKRPSCIGCKGTHGGTG

SEQ ID NO: 700 - protein, 9 aa, Homo sapiens
HARHGFLPR

SEQ ID NO: 701 - protein, 9 aa, Homo sapiens
IICYNWLHR

SEQ ID NO: 702 - protein, 9 aa, Homo sapiens
KLRAEIENL

SEQ ID NO: 703 - protein, 9 aa, Homo sapiens
KQRIKSQER

SEQ ID NO: 704 - protein, 10 aa, Homo sapiens
KRPSQRHGSK

SEQ ID NO: 705 - protein, 10 aa, Homo sapiens
LLAVLPVLLL

SEQ ID NO: 706 - protein, 9 aa, Homo sapiens
LLECCARCL

SEQ ID NO: 707 - protein, 9 aa, Homo sapiens
LQYRLRGKL

SEQ ID NO: 708 - protein, 8 aa, Homo sapiens
LRIRNVRF

SEQ ID NO: 709 - protein, 9 aa, Homo sapiens
LRKFSSLCY

SEQ ID NO: 710 - protein, 20 aa, Human herpesvirus
MSDEGPGTGPGNGLGEKGDT

SEQ ID NO: 711 - protein, 20 aa, Human herpesvirus
PGAIEQGPADDPGEGPSTGP

SEQ ID NO: 712 - protein, 7 aa, Human herpesvirus
PPPGRRP

SEQ ID NO: 713 - protein, 20 aa, Human herpesvirus
PQRRGGDNHGRGRGRGRGRG

SEQ ID NO: 714 - protein, 20 aa, Human herpesvirus
RGRGRGRGRGGGRPGAPGGS

SEQ ID NO: 715 - protein, 20 aa, Human herpesvirus
RRPQKRPSCIGCKGTHGGTG

SEQ ID NO: 716 - protein, 9 aa, Homo sapiens
RTELLKDAI

SEQ ID NO: 717 - protein, 10 aa, Homo sapiens
RVVHLYRNGK

SEQ ID NO: 718 - protein, 20 aa, Human herpesvirus
SGPEGSGGSGPQRRGGDNHG

SEQ ID NO: 719 - protein, 20 aa, Human herpesvirus
SGSPPRRPPPGRRPFFHPVG

SEQ ID NO: 720 - protein, 9 aa, Homo sapiens
SLDVMASQK

SEQ ID NO: 721 - protein, 36 aa, Human herpesvirus
SSQSSSSGSPPRRPPPGRRPFFHPVGEADYFEYHQE

SEQ ID NO: 722 - protein, 9 aa, Homo sapiens
TAHYGSLPQ

SEQ ID NO: 723 - protein, 20 aa, Homo sapiens
LSLSRFSWGAEGQRPGFGYG

SEQ ID NO: 724 - protein, 19 aa, Homo sapiens
AAHLPAEFTPAVHASLDKF

SEQ ID NO: 725 - protein, 15 aa, Homo sapiens
AAVGTSAAPVPSDNH

SEQ ID NO: 726 - protein, 13 aa, Homo sapiens
AEPPPPPPEPARI

SEQ ID NO: 727 - protein, 12 aa, Homo sapiens
AGEYDHLPEQAF

SEQ ID NO: 728 - protein, 11 aa, Homo sapiens
ALMEGGENGPW

SEQ ID NO: 729 - protein, 11 aa, Homo sapiens
ALMLAISHGRQ

SEQ ID NO: 730 - protein, 9 aa, Homo sapiens
ALYSGVHKK

SEQ ID NO: 731 - protein, 15 aa, Homo sapiens
AQVIILNHPGQISAG

SEQ ID NO: 732 - protein, 12 aa, Homo sapiens
ARKLIGDPNLEF

SEQ ID NO: 733 - protein, 10 aa, Homo sapiens
ASSSVLSSPA

SEQ ID NO: 734 - protein, 13 aa, Homo sapiens
ASVDLKNTGREEF

SEQ ID NO: 735 - protein, 14 aa, Homo sapiens
ASVDLKNTGREEFL

SEQ ID NO: 736 - protein, 16 aa, Homo sapiens
ASVDLKNTGREEFLTA

SEQ ID NO: 737 - protein, 10 aa, Homo sapiens
ATALPTGTSK

SEQ ID NO: 738 - protein, 9 aa, Homo sapiens
ATANQIILK

SEQ ID NO: 739 - protein, 9 aa, Homo sapiens
ATIIDILTK

SEQ ID NO: 740 - protein, 9 aa, Homo sapiens
ATVAGVHVK

SEQ ID NO: 741 - protein, 12 aa, Homo sapiens
ATVRQKLQDETN

SEQ ID NO: 742 - protein, 9 aa, Homo sapiens
ATVTPSPVK

SEQ ID NO: 743 - protein, 9 aa, Homo sapiens
AVALPLQTK

SEQ ID NO: 744 - protein, 12 aa, Homo sapiens
AVILPPLSPYFK

SEQ ID NO: 745 - protein, 9 aa, Homo sapiens
AVQRTLLEK

SEQ ID NO: 746 - protein, 9 aa, Homo sapiens
AVTDVIIAK

SEQ ID NO: 747 - protein, 17 aa, Homo sapiens
AVVDKAAEAGGAEEQYG

SEQ ID NO: 748 - protein, 9 aa, Homo sapiens
AVYSHVIQK

SEQ ID NO: 749 - protein, 12 aa, Homo sapiens
AWKRAEAIESSL

SEQ ID NO: 750 - protein, 10 aa, Homo sapiens
CPLSLAAQLD

SEQ ID NO: 751 - protein, 10 aa, Homo sapiens
DESGPSIVHR

SEQ ID NO: 752 - protein, 13 aa, Homo sapiens
DEWVKPKDMLGPK

SEQ ID NO: 753 - protein, 18 aa, Homo sapiens
DFAIVKFTKVLLQYTGHI

SEQ ID NO: 754 - protein, 14 aa, Homo sapiens
DGVIKVFNDMKVRK

SEQ ID NO: 755 - protein, 13 aa, Homo sapiens
DLPSEASASTAGP

SEQ ID NO: 756 - protein, 10 aa, Homo sapiens
DLPWFRTLSW

SEQ ID NO: 757 - protein, 13 aa, Homo sapiens
DLSQVAAISNDLK

SEQ ID NO: 758 - protein, 14 aa, Homo sapiens
DPPLIALDKDAPLR

SEQ ID NO: 759 - protein, 9 aa, Homo sapiens
DTDHYFLRY

SEQ ID NO: 760 - protein, 11 aa, Homo sapiens
DTGILDSIGRF

SEQ ID NO: 761 - protein, 14 aa, Homo sapiens
DVASVQQQRQEQSY

SEQ ID NO: 762 - protein, 15 aa, Homo sapiens
DVGVYRAVTPQGRPD

SEQ ID NO: 763 - protein, 10 aa, Homo sapiens
DVIGDLHQCQ

SEQ ID NO: 764 - protein, 9 aa, Homo sapiens
DVIRLIMQY

SEQ ID NO: 765 - protein, 12 aa, Homo sapiens
EIIEETKVEDEK

SEQ ID NO: 766 - protein, 15 aa, Homo sapiens
EIIVTHFPFDEQNCS

SEQ ID NO: 767 - protein, 10 aa, Homo sapiens
ELINNELSHF

SEQ ID NO: 768 - protein, 17 aa, Homo sapiens
EPGEPEFKYIGNMHGNE

SEQ ID NO: 769 - protein, 15 aa, Homo sapiens
EPNAIVSDGKYHVVR

SEQ ID NO: 770 - protein, 10 aa, Homo sapiens
ERIAGLEQED

SEQ ID NO: 771 - protein, 11 aa, Homo sapiens
ERTAKELDTNT

SEQ ID NO: 772 - protein, 15 aa, Homo sapiens
ESNAIINDGKYHVVR

SEQ ID NO: 773 - protein, 11 aa, Homo sapiens
ETDLLDIRSEY

SEQ ID NO: 774 - protein, 10 aa, Homo sapiens
EVGGEALGRL

SEQ ID NO: 775 - protein, 9 aa, Homo sapiens
FGESLPARF

SEQ ID NO: 776 - protein, 10 aa, Homo sapiens
FGYSNRVVDL

SEQ ID NO: 777 - protein, 13 aa, Homo sapiens
FITADHLIEKLRT

SEQ ID NO: 778 - protein, 12 aa, Homo sapiens
FLGVAYGATRYN

SEQ ID NO: 779 - protein, 14 aa, Homo sapiens
FLSFPTTKTYFPHF

SEQ ID NO: 780 - protein, 12 aa, Homo sapiens
FRDGDILGKYVD

SEQ ID NO: 781 - protein, 11 aa, Homo sapiens
FRDQEGQDVLL

SEQ ID NO: 782 - protein, 10 aa, Homo sapiens
FRELNEALEL

SEQ ID NO: 783 - protein, 12 aa, Homo sapiens
FRIDSVSEGNAG

SEQ ID NO: 784 - protein, 13 aa, Homo sapiens
FSETGAGKHVPRA

SEQ ID NO: 785 - protein, 15 aa, Homo sapiens
FSETGAGKHVPRAVF

SEQ ID NO: 786 - protein, 10 aa, Homo sapiens
FSQFGPIERA

SEQ ID NO: 787 - protein, 10 aa, Homo sapiens
FSVATVQTTW

SEQ ID NO: 788 - protein, 12 aa, Homo sapiens
FTPAVHASLDKF

SEQ ID NO: 789 - protein, 8 aa, Homo sapiens
FTRSLFVN

SEQ ID NO: 790 - protein, 9 aa, Homo sapiens
FVNDIFERI

SEQ ID NO: 791 - protein, 8 aa, Homo sapiens
FVQMMTAK

SEQ ID NO: 792 - protein, 14 aa, Homo sapiens
GHLYREDQTSPAPG

SEQ ID NO: 793 - protein, 16 aa, Homo sapiens
GKVNVDEVGGEALGRL

SEQ ID NO: 794 - protein, 17 aa, Homo sapiens
GKVNVDEVGGEALGRLL

SEQ ID NO: 795 - protein, 14 aa, Homo sapiens
GNRIAQWQSFQLEG

SEQ ID NO: 796 - protein, 10 aa, Homo sapiens
GRTLQNTMVN

SEQ ID NO: 797 - protein, 12 aa, Homo sapiens
GRTTGIVMDSGD

SEQ ID NO: 798 - protein, 9 aa, Homo sapiens
GTADVHFER

SEQ ID NO: 799 - protein, 9 aa, Homo sapiens
GTFGGLGSK

SEQ ID NO: 800 - protein, 9 aa, Homo sapiens
GTINIVHPK

SEQ ID NO: 801 - protein, 10 aa, Homo sapiens
GVIDVITKTW

SEQ ID NO: 802 - protein, 17 aa, Homo sapiens
GWSSHPPPSPCREQEIR

SEQ ID NO: 803 - protein, 15 aa, Homo sapiens
HGSKYLATASTMDHA

SEQ ID NO: 804 - protein, 9 aa, Homo sapiens
HIILVLSGK

SEQ ID NO: 805 - protein, 9 aa, Homo sapiens
HSERHVLLY

SEQ ID NO: 806 - protein, 9 aa, Homo sapiens
IFANAHTYH

SEQ ID NO: 807 - protein, 8 aa, Homo sapiens
IFEKSFVN

SEQ ID NO: 808 - protein, 11 aa, Homo sapiens
IIEETKVEDEK

SEQ ID NO: 809 - protein, 9 aa, Homo sapiens
IIYKGGTSR

SEQ ID NO: 810 - protein, 9 aa, Homo sapiens
IPMGKSMLV

SEQ ID NO: 811 - protein, 10 aa, Homo sapiens
IPNKNRAEQL

SEQ ID NO: 812 - protein, 13 aa, Homo sapiens
IREADIDGDGQVN

SEQ ID NO: 813 - protein, 12 aa, Homo sapiens
IRETSLDTKSVS

SEQ ID NO: 814 - protein, 12 aa, Homo sapiens
ISKLSAKFGGQA

SEQ ID NO: 815 - protein, 16 aa, Homo sapiens
ISKQEYDESGPSIVHR

SEQ ID NO: 816 - protein, 17 aa, Homo sapiens
ISKQEYDESGPSIVHRK

SEQ ID NO: 817 - protein, 17 aa, Homo sapiens
ISWYDNEFGYSNRVVDL

SEQ ID NO: 818 - protein, 13 aa, Homo sapiens
ITANATEPQKAEN

SEQ ID NO: 819 - protein, 12 aa, Homo sapiens
ITQNGDYQLRTQ

SEQ ID NO: 820 - protein, 14 aa, Homo sapiens
ITSIVKDSSAARNG

SEQ ID NO: 821 - protein, 9 aa, Homo sapiens
IVAGTLTNK

SEQ ID NO: 822 - protein, 16 aa, Homo sapiens
IVTPRTPPPSQGKGRG

SEQ ID NO: 823 - protein, 18 aa, Homo sapiens
IVTPRTPPPSQGKGRGLS

SEQ ID NO: 824 - protein, 11 aa, Homo sapiens
IVVYPVHGFMY

SEQ ID NO: 825 - protein, 9 aa, Homo sapiens
KIADRFLLY

SEQ ID NO: 826 - protein, 15 aa, Homo sapiens
KIWRPDLVLYNNADG

SEQ ID NO: 827 - protein, 10 aa, Homo sapiens
KPRDVSSVEL

SEQ ID NO: 828 - protein, 11 aa, Homo sapiens
KPTISVKEAFY

SEQ ID NO: 829 - protein, 17 aa, Homo sapiens
KSAIEGIKYIAETMKSD

SEQ ID NO: 830 - protein, 9 aa, Homo sapiens
KTYGEIFEK

SEQ ID NO: 831 - protein, 14 aa, Homo sapiens
KVKKIYLDEKRLLA

SEQ ID NO: 832 - protein, 15 aa, Homo sapiens
KVKKIYLDEKRLLAG

SEQ ID NO: 833 - protein, 16 aa, Homo sapiens
KVKKIYLDEKRLLAGD

SEQ ID NO: 834 - protein, 13 aa, Homo sapiens
KVVPEMTEILKKK

SEQ ID NO: 835 - protein, 11 aa, Homo sapiens
KVYNEAGVTFT

SEQ ID NO: 836 - protein, 12 aa, Homo sapiens
KYLPGPLQDMFK

SEQ ID NO: 837 - protein, 11 aa, Homo sapiens
LASGVHGLPLL

SEQ ID NO: 838 - protein, 12 aa, Homo sapiens
LASVSTVLTSKY

SEQ ID NO: 839 - protein, 13 aa, Homo sapiens
LDFLKAVDTNRAS

SEQ ID NO: 840 - protein, 11 aa, Homo sapiens
LDTHPLPLVEV

SEQ ID NO: 841 - protein, 15 aa, Homo sapiens
LERIQIQEAAKKKPG

SEQ ID NO: 842 - protein, 9 aa, Homo sapiens
LFALTLPIW

SEQ ID NO: 843 - protein, 11 aa, Homo sapiens
LGSVAGIFNYY

SEQ ID NO: 844 - protein, 10 aa, Homo sapiens
LGVLESDLPS

SEQ ID NO: 845 - protein, 12 aa, Homo sapiens
LILPEAVGGTVF

SEQ ID NO: 846 - protein, 10 aa, Homo sapiens
LLPPPPPVAR

SEQ ID NO: 847 - protein, 13 aa, Homo sapiens
LLVIVELIPSTSS

SEQ ID NO: 848 - protein, 14 aa, Homo sapiens
LLVPTKARFPAFEL

SEQ ID NO: 849 - protein, 13 aa, Homo sapiens
LNETGDEPFQYKN

SEQ ID NO: 850 - protein, 14 aa, Homo sapiens
LNTILPDARDPAFK

SEQ ID NO: 851 - protein, 11 aa, Homo sapiens
LRPIQALGTEY

SEQ ID NO: 852 - protein, 14 aa, Homo sapiens
LSALEEYTKKLNTQ

SEQ ID NO: 853 - protein, 13 aa, Homo sapiens
LSFPTTKTYFPHF

SEQ ID NO: 854 - protein, 9 aa, Homo sapiens
LTDRELEEY

SEQ ID NO: 855 - protein, 9 aa, Homo sapiens
LVEAKQYII

SEQ ID NO: 856 - protein, 10 aa, Homo sapiens
LVSASQDGKL

SEQ ID NO: 857 - protein, 10 aa, Homo sapiens
LVVYFFRVRN

SEQ ID NO: 858 - protein, 10 aa, Homo sapiens
MLSNPDLMRQ

SEQ ID NO: 859 - protein, 9 aa, Homo sapiens
MPILGLGTW

SEQ ID NO: 860 - protein, 15 aa, Homo sapiens
MSILGMTPGFGDKTF

SEQ ID NO: 861 - protein, 10 aa, Homo sapiens
MSLKQTPLSR

SEQ ID NO: 862 - protein, 10 aa, Homo sapiens
NEIEDTFRQF

SEQ ID NO: 863 - protein, 12 aa, Homo sapiens
NETGDEPFQYKN

SEQ ID NO: 864 - protein, 15 aa, Homo sapiens
NQELRADGTVNQIEG

SEQ ID NO: 865 - protein, 10 aa, Homo sapiens
NRITIPVQTF

SEQ ID NO: 866 - protein, 8 aa, Homo sapiens
NTDSPLRY

SEQ ID NO: 867 - protein, 9 aa, Homo sapiens
NTEEEGLKY

SEQ ID NO: 868 - protein, 18 aa, Homo sapiens
NWVRKVFIDTIPNIMFFS

SEQ ID NO: 869 - protein, 11 aa, Homo sapiens
PEVLNRALSNL

SEQ ID NO: 870 - protein, 11 aa, Homo sapiens
PKFEVIEKPQA

SEQ ID NO: 871 - protein, 15 aa, Homo sapiens
PQRFVVIQNEDLGPA

SEQ ID NO: 872 - protein, 11 aa, Homo sapiens
PSIHIWDTETI

SEQ ID NO: 873 - protein, 13 aa, Homo sapiens
PVDLSKWSGPLSL

SEQ ID NO: 874 - protein, 14 aa, Homo sapiens
QEELPSLWNSRVGF

SEQ ID NO: 875 - protein, 11 aa, Homo sapiens
QIRETSLDTKS

SEQ ID NO: 876 - protein, 9 aa, Homo sapiens
QLYMIQKKS

SEQ ID NO: 877 - protein, 9 aa, Homo sapiens
QLYWSHPRK

SEQ ID NO: 878 - protein, 11 aa, Homo sapiens
QSMDSKLSGRY

SEQ ID NO: 879 - protein, 19 aa, Homo sapiens
QTPQHPSFLFQDKRVSWSL

SEQ ID NO: 880 - protein, 10 aa, Homo sapiens
QVADVVVSRW

SEQ ID NO: 881 - protein, 10 aa, Homo sapiens
QVLGVVARAA

SEQ ID NO: 882 - protein, 9 aa, Homo sapiens
RAIEQLAMM

SEQ ID NO: 883 - protein, 10 aa, Homo sapiens
RHGSKYLATA

SEQ ID NO: 884 - protein, 18 aa, Homo sapiens
RHGSKYLATASTMDHARH

SEQ ID NO: 885 - protein, 10 aa, Homo sapiens
RLYPWGVVEV

SEQ ID NO: 886 - protein, 10 aa, Homo sapiens
RQQPPDLVEF

SEQ ID NO: 887 - protein, 11 aa, Homo sapiens
SCGDLHSVMLE

SEQ ID NO: 888 - protein, 15 aa, Homo sapiens
SEHETRLVAKLFKDY

SEQ ID NO: 889 - protein, 11 aa, Homo sapiens
SGCDLEEIPLD

SEQ ID NO: 890 - protein, 14 aa, Homo sapiens
SHGRTQDENPVVHF

SEQ ID NO: 891 - protein, 10 aa, Homo sapiens
SHPPVEGSYA

SEQ ID NO: 892 - protein, 9 aa, Homo sapiens
SIFKQPVTK

SEQ ID NO: 893 - protein, 9 aa, Homo sapiens
SITSVFITK

SEQ ID NO: 894 - protein, 14 aa, Homo sapiens
SNAIINDGKYHVVR

SEQ ID NO: 895 - protein, 12 aa, Homo sapiens
SSKFQVDNNNRL

SEQ ID NO: 896 - protein, 10 aa, Homo sapiens
STDPSVLGKY

SEQ ID NO: 897 - protein, 9 aa, Homo sapiens
STIEYVIQR

SEQ ID NO: 898 - protein, 11 aa, Homo sapiens
STIGPEGVHQK

SEQ ID NO: 899 - protein, 12 aa, Homo sapiens
SVAALSCLMLVA

SEQ ID NO: 900 - protein, 10 aa, Homo sapiens
SVFQQGMKNK

SEQ ID NO: 901 - protein, 11 aa, Homo sapiens
SVPEFPLSPPK

SEQ ID NO: 902 - protein, 9 aa, Homo sapiens
SVSPVVHVR

SEQ ID NO: 903 - protein, 8 aa, Homo sapiens
TAIRHHVL

SEQ ID NO: 904 - protein, 10 aa, Homo sapiens
TGILDSIGRF

SEQ ID NO: 905 - protein, 11 aa, Homo sapiens
TIIDLPGITRV

SEQ ID NO: 906 - protein, 10 aa, Homo sapiens
TIQKSSLDQL

SEQ ID NO: 907 - protein, 9 aa, Homo sapiens
TLLGDFIYW

SEQ ID NO: 908 - protein, 10 aa, Homo sapiens
TMDHARHGFL

SEQ ID NO: 909 - protein, 16 aa, Homo sapiens
TNVPRASVPDGFLSEL

SEQ ID NO: 910 - protein, 14 aa, Homo sapiens
TPDAMKAAMALEKK

SEQ ID NO: 911 - protein, 16 aa, Homo sapiens
TSPAKQQAPPVRNLHQ

SEQ ID NO: 912 - protein, 10 aa, Homo sapiens
TTGILSILFY

SEQ ID NO: 913 - protein, 15 aa, Homo sapiens
TTMEKAGAHLQGGAK

SEQ ID NO: 914 - protein, 9 aa, Homo sapiens
TTYNYAVLK

SEQ ID NO: 915 - protein, 8 aa, Homo sapiens
TVFSTHFM

SEQ ID NO: 916 - protein, 12 aa, Homo sapiens
VDLEPTVIDEVR

SEQ ID NO: 917 - protein, 13 aa, Homo sapiens
VDPENFRLLGNVL

SEQ ID NO: 918 - protein, 12 aa, Homo sapiens
VDWIILQCAEDI

SEQ ID NO: 919 - protein, 12 aa, Homo sapiens
VEESKDAGIRTL

SEQ ID NO: 920 - protein, 10 aa, Homo sapiens
VGGEALGRLL

SEQ ID NO: 921 - protein, 13 aa, Homo sapiens
VHLKNASRGSAGN

SEQ ID NO: 922 - protein, 12 aa, Homo sapiens
VHLTPEEKSAVT

SEQ ID NO: 923 - protein, 31 aa, Homo sapiens
VHLTPEEKSAVTALWGKVNVDEVGGEALGRL

SEQ ID NO: 924 - protein, 10 aa, Homo sapiens
VIRLLLASGA

SEQ ID NO: 925 - protein, 9 aa, Homo sapiens
VLGDLFVRD

SEQ ID NO: 926 - protein, 11 aa, Homo sapiens
VLSPADKTNVK

SEQ ID NO: 927 - protein, 25 aa, Homo sapiens
VLSPADKTNVKAAWGKVGAHAGEYG

SEQ ID NO: 928 - protein, 31 aa, Homo sapiens
VLSPADKTNVKAAWGKVGAHAGEYGAEALER

SEQ ID NO: 929 - protein, 7 aa, Homo sapiens
VQMMTAK

SEQ ID NO: 930 - protein, 15 aa, Homo sapiens
VSHFFRELAEEKREG

SEQ ID NO: 931 - protein, 10 aa, Homo sapiens
VTASKAIIEK

SEQ ID NO: 932 - protein, 9 aa, Homo sapiens
VTMTASRML

SEQ ID NO: 933 - protein, 9 aa, Homo sapiens
VTNPDTGRY

SEQ ID NO: 934 - protein, 16 aa, Homo sapiens
VTPRTPPPSQGKGRGL

SEQ ID NO: 935 - protein, 9 aa, Homo sapiens
VTSPIRASY

SEQ ID NO: 936 - protein, 12 aa, Homo sapiens
VTVFPIGIGDRY

SEQ ID NO: 937 - protein, 14 aa, Homo sapiens
VVAGVANALAHKYH

SEQ ID NO: 938 - protein, 11 aa, Homo sapiens
VVIRGNSIIML

SEQ ID NO: 939 - protein, 11 aa, Homo sapiens
VVYPSSSQESE

SEQ ID NO: 940 - protein, 8 aa, Homo sapiens
VYRVNSYW

SEQ ID NO: 941 - protein, 17 aa, Homo sapiens
WISKQEYDESGPSIVHR

SEQ ID NO: 942 - protein, 18 aa, Homo sapiens
WISKQEYDESGPSIVHRK

SEQ ID NO: 943 - protein, 20 aa, Homo sapiens
WISKQEYDESGPSIVHRKCF

SEQ ID NO: 944 - protein, 10 aa, Homo sapiens
WSTVLSTYHF

SEQ ID NO: 945 - protein, 11 aa, Homo sapiens
WTTGTISSQRF

SEQ ID NO: 946 - protein, 13 aa, Homo sapiens
WVPYINGKFKKDN

SEQ ID NO: 947 - protein, 15 aa, Homo sapiens
WVSQRTATAGTASPP

SEQ ID NO: 948 - protein, 11 aa, Homo sapiens
YAVAVVKKDSG

SEQ ID NO: 949 - protein, 11 aa, Homo sapiens
YDESGPSIVHR

SEQ ID NO: 950 - protein, 12 aa, Homo sapiens
YDESGPSIVHRK

SEQ ID NO: 951 - protein, 14 aa, Homo sapiens
YDNEFGYSNRVVDL

SEQ ID NO: 952 - protein, 11 aa, Homo sapiens
YEMPSEEGYQD

SEQ ID NO: 953 - protein, 8 aa, Homo sapiens
YEVSQLKD

SEQ ID NO: 954 - protein, 8 aa, Homo sapiens
YGMPRQIL

SEQ ID NO: 955 - protein, 9 aa, Homo sapiens
YIDEQFERY

SEQ ID NO: 956 - protein, 10 aa, Homo sapiens
YIKEDEALPS

SEQ ID NO: 957 - protein, 9 aa, Homo sapiens
YLLLLLLLS

SEQ ID NO: 958 - protein, 13 aa, Homo sapiens
YQKVVAGVANALA

SEQ ID NO: 959 - protein, 17 aa, Homo sapiens
YQKVVAGVANALAHKYH

SEQ ID NO: 960 - protein, 10 aa, Homo sapiens
YTDVPFHNQY

SEQ ID NO: 961 - protein, 11 aa, Homo sapiens
YTERDASGMLY

SEQ ID NO: 962 - protein, 9 aa, Homo sapiens
APAHAITLT

SEQ ID NO: 963 - protein, 9 aa, Multiple sclerosis associated retrovirus
ATLKPATFL

SEQ ID NO: 964 - protein, 9 aa, Human endogenous retrovirus W
ATLNPATFL

SEQ ID NO: 965 - protein, 9 aa, Homo sapiens
CPRQRSSRA

SEQ ID NO: 966 - protein, 9 aa, Multiple sclerosis associated retrovirus
DPLNPTSQL

SEQ ID NO: 967 - protein, 9 aa, Multiple sclerosis associated retrovirus
FPYQRKYPL

SEQ ID NO: 968 - protein, 9 aa, Homo sapiens
GPARVPVPF

SEQ ID NO: 969 - protein, 9 aa, Multiple sclerosis associated retrovirus
GPCFLWLKL

SEQ ID NO: 970 - protein, 9 aa, Multiple sclerosis associated retrovirus
IPEEAEWFT

SEQ ID NO: 971 - protein, 9 aa, Multiple sclerosis associated retrovirus
IPFLGIRET

SEQ ID NO: 972 - protein, 9 aa, Homo sapiens
IPPKAKTPL

SEQ ID NO: 973 - protein, 9 aa, Homo sapiens
IPRLCPLQA

SEQ ID NO: 974 - protein, 12 aa, Multiple sclerosis associated retrovirus
IPVRPDSQFLFA

SEQ ID NO: 975 - protein, 12 aa, Homo sapiens
KEENPTAFLDRL

SEQ ID NO: 976 - protein, 9 aa, Multiple sclerosis associated retrovirus
KPNGQWRLV

SEQ ID NO: 977 - protein, 9 aa, Multiple sclerosis associated retrovirus
KPPPCPCPL

SEQ ID NO: 978 - protein, 9 aa, Multiple sclerosis associated retrovirus
KVSKPKARL

SEQ ID NO: 979 - protein, 9 aa, Multiple sclerosis associated retrovirus
LPLGSEQNL

SEQ ID NO: 980 - protein, 9 aa, Multiple sclerosis associated retrovirus
LPTGQDFSL

SEQ ID NO: 981 - protein, 14 aa, Multiple sclerosis associated retrovirus
MPESPTPLLGRDIL

SEQ ID NO: 982 - protein, 11 aa, Multiple sclerosis associated retrovirus
MPSPSEPRVCL

SEQ ID NO: 983 - protein, 9 aa, Homo sapiens
NPDGYIDVL

SEQ ID NO: 984 - protein, 12 aa, Human endogenous retrovirus W
NPHTPGTSTQLA

SEQ ID NO: 985 - protein, 9 aa, Multiple sclerosis associated retrovirus
NPRSENTRL

SEQ ID NO: 986 - protein, 15 aa, Multiple sclerosis associated retrovirus
PPPYPSVPSPTPSST

SEQ ID NO: 987 - protein, 9 aa, Homo sapiens
QPLSCDWGT

SEQ ID NO: 988 - protein, 9 aa, Multiple sclerosis associated retrovirus
RPAADFHPF

SEQ ID NO: 989 - protein, 11 aa, Multiple sclerosis associated retrovirus
RPLPLPIGLKA

SEQ ID NO: 990 - protein, 9 aa, Homo sapiens
SPDSIEGQL

SEQ ID NO: 991 - protein, 9 aa, Multiple sclerosis associated retrovirus
SPHLFGQAL

SEQ ID NO: 992 - protein, 9 aa, Multiple sclerosis associated retrovirus
TPIARPLYT

SEQ ID NO: 993 - protein, 9 aa, Homo sapiens
TPNERSAAV

SEQ ID NO: 994 - protein, 9 aa, Homo sapiens
VPCLRKELI

SEQ ID NO: 995 - protein, 9 aa, Multiple sclerosis associated retrovirus
VPPEAKMPL

SEQ ID NO: 996 - protein, 9 aa, Multiple sclerosis associated retrovirus
WPHCLWVMA

SEQ ID NO: 997 - protein, 11 aa, Multiple sclerosis associated retrovirus
YPAVSSPYTLL

SEQ ID NO: 998 - protein, 21 aa, Human T-cell lymphotropic virus
PPPPSSPTHDPPDSDPQIPPP

SEQ ID NO: 999 - protein, 21 aa, Homo sapiens
PTRAPSGPRPPSRSQAQTPPR

SEQ ID NO: 1000 - protein, 12 aa, Homo sapiens
ALTIYEMLQNIF

SEQ ID NO: 1001 - protein, 12 aa, Homo sapiens
CAWTIVRVEILR

SEQ ID NO: 1002 - protein, 12 aa, Homo sapiens
CLKDRMNFDIPE

SEQ ID NO: 1003 - protein, 15 aa, Helicobacter pylori
EEFIFHFIKNTRDGL

SEQ ID NO: 1004 - protein, 12 aa, Homo sapiens
EMLQNIFAIFRQ

SEQ ID NO: 1005 - protein, 12 aa, Homo sapiens
ETIVENLLANVY

SEQ ID NO: 1006 - protein, 12 aa, Homo sapiens
FTRGKLMSSLHL

SEQ ID NO: 1007 - protein, 12 aa, Homo sapiens
GRLEYCLKDRMN

SEQ ID NO: 1008 - protein, 12 aa, Homo sapiens
HLKRYYGRILHY

SEQ ID NO: 1009 - protein, 12 aa, Homo sapiens
HYLKAKEYSHCA

SEQ ID NO: 1010 - protein, 12 aa, Homo sapiens
KEYSHCAWTIVR

SEQ ID NO: 1011 - protein, 12 aa, Homo sapiens
LEKEDFTRGKLM

SEQ ID NO: 1012 - protein, 12 aa, Homo sapiens
LGFLQRSSNFQC

SEQ ID NO: 1013 - protein, 12 aa, Homo sapiens
LMSSLHLKRYYG

SEQ ID NO: 1014 - protein, 12 aa, Homo sapiens
LRNFYFINRLTG

SEQ ID NO: 1015 - protein, 12 aa, Homo sapiens
LWQLNGRLEYCL

SEQ ID NO: 1016 - protein, 12 aa, Homo sapiens
MNFDIPEEIKQL

SEQ ID NO: 1017 - protein, 12 aa, Homo sapiens
MSYNLLGFLQRS

SEQ ID NO: 1018 - protein, 12 aa, Homo sapiens
NHLKTVLEEKLE

SEQ ID NO: 1019 - protein, 12 aa, Homo sapiens
NLLANVYHQINH

SEQ ID NO: 1020 - protein, 12 aa, Homo sapiens
PEEIKQLQQFQK

SEQ ID NO: 1021 - protein, 12 aa, Homo sapiens
QCQKLLWQLNGR

SEQ ID NO: 1022 - protein, 12 aa, Homo sapiens
QKEDAALTIYEM

SEQ ID NO: 1023 - protein, 12 aa, Homo sapiens
QLQQFQKEDAAL

SEQ ID NO: 1024 - protein, 12 aa, Homo sapiens
RQDSSSTGWNET

SEQ ID NO: 1025 - protein, 12 aa, Homo sapiens
RSSNFQCQKLLW

SEQ ID NO: 1026 - protein, 12 aa, Homo sapiens
STGWNETIVENL

SEQ ID NO: 1027 - protein, 12 aa, Homo sapiens
VLEEKLEKEDFT

SEQ ID NO: 1028 - protein, 12 aa, Homo sapiens
VRVEILRNFYFI

SEQ ID NO: 1029 - protein, 12 aa, Homo sapiens
VYHQINHLKTVL

SEQ ID NO: 1030 - protein, 12 aa, Homo sapiens
YFINRLTGYLRN

SEQ ID NO: 1031 - protein, 12 aa, Homo sapiens
YGRILHYLKAKE

SEQ ID NO: 1032 - skipped

SEQ ID NO: 1033 - protein, 10 aa, unidentified
  REGION 1..10: note = epitope involved in multiple sclerosis
LIMFKNVVIK

SEQ ID NO: 1034 - protein, 11 aa, unidentified
  REGION 1..11: note = epitope involved in multiple sclerosis
VIIFFKNVVIK

SEQ ID NO: 1035 - protein, 11 aa, Homo sapiens
VVHFFKNIVTP

SEQ ID NO: 1036 - protein, 11 aa, unidentified
  REGION 1..11: note = epitope involved in multiple sclerosis
VVHFFKNVVIK

SEQ ID NO: 1037 - protein, 11 aa, unidentified
  REGION 1..11: note = epitope involved in multiple sclerosis
VVHFFKNVVIP

SEQ ID NO: 1038 - protein, 11 aa, unidentified
  REGION 1..11: note = epitope involved in multiple sclerosis
VVHFFKNVVTP

SEQ ID NO: 1039 - skipped

SEQ ID NO: 1040 - protein, 11 aa, unidentified
  REGION 1..11: note = epitope involved in multiple sclerosis
VVIFFKNVVIK

SEQ ID NO: 1041 - protein, 7 aa, unidentified
  REGION 1..7: note = epitope involved in multiple sclerosis
ERPNHTV

SEQ ID NO: 1042 - protein, 5 aa, unidentified
  REGION 1..5: note = epitope involved in multiple sclerosis
RPNHT

SEQ ID NO: 1043 - protein, 21 aa, unidentified
  REGION 1..21: note = epitope involved in multiple sclerosis
TPRVERGNHTVFLAPYGWMVK

SEQ ID NO: 1044 - protein, 21 aa, unidentified
  REGION 1..21: note = epitope involved in multiple sclerosis
TPRVERNGHSVFLAPYGWMVK

SEQ ID NO: 1045 - protein, 21 aa, unidentified
  REGION 1..21: note = epitope involved in multiple sclerosis
TPRVERPNHTVFLAPYGWMVK

SEQ ID NO: 1046 - protein, 19 aa, Homo sapiens
ADDLKKLKPGLEKDFLPLY

SEQ ID NO: 1047 - protein, 19 aa, Homo sapiens
AVQTGLDLLEILRQEKGGS

SEQ ID NO: 1048 - protein, 19 aa, Homo sapiens
DNLPRGSRAHITLGCAADV

SEQ ID NO: 1049 - protein, 21 aa, Homo sapiens
DQYQYQVVLVEPKTAWRLDCA

SEQ ID NO: 1050 - protein, 18 aa, Homo sapiens
DTVATLLECKTLFILRGL

SEQ ID NO: 1051 - protein, 34 aa, Homo sapiens
DVLKKSYSKAFTLTISALFVTPKTTGARVELSEQ

SEQ ID NO: 1052 - protein, 19 aa, Homo sapiens
EELGNHKAFKKELRQFVPG

SEQ ID NO: 1053 - protein, 18 aa, Homo sapiens
ELQFPFLQDEDTVATLLE

SEQ ID NO: 1054 - protein, 18 aa, Homo sapiens
ELSEQQLQLWPSDVDKLS

SEQ ID NO: 1055 - protein, 19 aa, Homo sapiens
EPREKMDLVTYFGKRPPGV

SEQ ID NO: 1056 - protein, 39 aa, Homo sapiens
FPFLQDEDTVATLLECKTLFILRGLPGSGKSTLARVIVD

SEQ ID NO: 1057 - protein, 19 aa, Homo sapiens
GARGAFSEEYKRLDEDLAA

SEQ ID NO: 1058 - protein, 19 aa, Homo sapiens
GEEVGELSRGKLYSLGNGR

SEQ ID NO: 1059 - protein, 21 aa, Homo sapiens
GKPVPTQGSRKGGALQSCTII

SEQ ID NO: 1060 - protein, 19 aa, Homo sapiens
GWFLTKKSSETLRKAGQVF

SEQ ID NO: 1061 - protein, 19 aa, Homo sapiens
HCTTKFCDYGKAPGAEEYA

SEQ ID NO: 1062 - protein, 19 aa, Homo sapiens
ILRQEKGGSRGEEVGELSR

SEQ ID NO: 1063 - protein, 19 aa, Homo sapiens
ITLGCAADVEAVQTGLDLL

SEQ ID NO: 1064 - protein, 20 aa, Homo sapiens
KAFTLTISALFVTPKTTGAR

SEQ ID NO: 1065 - protein, 19 aa, Homo sapiens
KAPGAEEYAQQDVLKKSYS

SEQ ID NO: 1066 - protein, 19 aa, Mus musculus
KEKRQFVPGDEPREKMDLV

SEQ ID NO: 1067 - protein, 32 aa, Homo sapiens
KKLKPGLEKDFLPLYFGWFLTKKSSETLRKAG

SEQ ID NO: 1068 - protein, 19 aa, Homo sapiens
KLYSLGNGRWMLTLAKNME

SEQ ID NO: 1069 - protein, 19 aa, Homo sapiens
KRLDEDLAAYCRRRDIRIL

SEQ ID NO: 1070 - protein, 19 aa, Homo sapiens
KTAWRLDCAQLKEKNQWQL

SEQ ID NO: 1071 - protein, 19 aa, Homo sapiens
LDDTNHERERLEQLFEMAD

SEQ ID NO: 1072 - protein, 19 aa, Homo sapiens
LEKDFLPLYFGWFLTKKSS

SEQ ID NO: 1073 - protein, 18 aa, Mus musculus
LEQLFEMADQYQQVVLVE

SEQ ID NO: 1074 - protein, 18 aa, Homo sapiens
LKEKNQWQLSADDLKKLK

SEQ ID NO: 1075 - protein, 19 aa, Homo sapiens
MLTLAKNMEVRAIFTGYYG

SEQ ID NO: 1076 - protein, 19 aa, Homo sapiens
MSSSGAKDKPELQFPFLQD

SEQ ID NO: 1077 - protein, 19 aa, Homo sapiens
PSDVDKLSPTDNLPRGSRA

SEQ ID NO: 1078 - protein, 19 aa, Homo sapiens
QDVLKKSYSKAFTLTISAL

SEQ ID NO: 1079 - protein, 19 aa, Homo sapiens
RAIFTGYYGKGKPVPTQGS

SEQ ID NO: 1080 - protein, 18 aa, Homo sapiens
RRRDIRILVLDDTNHERE

SEQ ID NO: 1081 - protein, 19 aa, Homo sapiens
SGKSTLARVIVDKYRDGTK

SEQ ID NO: 1082 - protein, 19 aa, Homo sapiens
TLFILRGLPGSGKSTLARV

SEQ ID NO: 1083 - protein, 19 aa, Homo sapiens
TLRKAGQVFLEELGNHKAF

SEQ ID NO: 1084 - protein, 19 aa, Homo sapiens
VDKYRDGTKMVSADAYKIT

SEQ ID NO: 1085 - protein, 19 aa, Homo sapiens
VSADAYKITPGARGAFSEE

SEQ ID NO: 1086 - protein, 19 aa, Homo sapiens
VTPKTTGARVELSEQQLQL

SEQ ID NO: 1087 - protein, 19 aa, Homo sapiens
YFGKRPPGVLHCTTKFCDY

SEQ ID NO: 1088 - protein, 16 aa, Homo sapiens
AAMELKVEDPFYWVSP

SEQ ID NO: 1089 - protein, 9 aa, Homo sapiens
CLQYRLRGK

SEQ ID NO: 1090 - protein, 16 aa, Homo sapiens
CWKITLFVIVPVLGPL

SEQ ID NO: 1091 - protein, 16 aa, Homo sapiens
DPFYWVSPGVLVLLAV

SEQ ID NO: 1092 - protein, 16 aa, Homo sapiens
DPHFLRVPCWKITLFV

SEQ ID NO: 1093 - protein, 16 aa, Homo sapiens
EGGFTCFFRDHSYQEE

SEQ ID NO: 1094 - protein, 16 aa, Homo sapiens
ELPCRISPGKNATGME

SEQ ID NO: 1095 - protein, 17 aa, Homo sapiens
ENPVVHFFKNIVTPRTP

SEQ ID NO: 1096 - protein, 9 aa, Homo sapiens
FLCLQYRLR

SEQ ID NO: 1097 - protein, 16 aa, Homo sapiens
GDEVELPCRISPGKNA

SEQ ID NO: 1098 - protein, 16 aa, Homo sapiens
GEGKVTLRIRNVRFSD

SEQ ID NO: 1099 - protein, 16 aa, Homo sapiens
GKNATGMEVGWYRPPF

SEQ ID NO: 1100 - protein, 9 aa, Homo sapiens
GLVFLCLQY

SEQ ID NO: 1101 - protein, 16 aa, Homo sapiens
GQFRVIGPRHPIRALV

SEQ ID NO: 1102 - protein, 16 aa, Homo sapiens
GVLVLLAVLPVLLLQI

SEQ ID NO: 1103 - protein, 16 aa, Homo sapiens
HLYRNGKDQDGDQAPE

SEQ ID NO: 1104 - protein, 16 aa, Homo sapiens
HRTFDPHFLRVPCWKI

SEQ ID NO: 1105 - protein, 16 aa, Homo sapiens
ICYNWLHRRLAGQFLE

SEQ ID NO: 1106 - protein, 16 aa, Homo sapiens
IENLHRTFDPHFLRVP

SEQ ID NO: 1107 - protein, 16 aa, Homo sapiens
IRNVRFSDEGGFTCFF

SEQ ID NO: 1108 - protein, 16 aa, Homo sapiens
IVPVLGPLVALIICYN

SEQ ID NO: 1109 - protein, 16 aa, Homo sapiens
KDAIGEGKVTLRIRNV

SEQ ID NO: 1110 - protein, 21 aa, Homo sapiens
KNATGMEVGWYRPPFSRVVHL

SEQ ID NO: 1111 - protein, 21 aa, Homo sapiens
KNATGMEVGWYRPPFSRVVHL

SEQ ID NO: 1112 - protein, 9 aa, Homo sapiens
LCLQYRLRG

SEQ ID NO: 1113 - protein, 16 aa, Homo sapiens
LGPLVALIICYNWLHR

SEQ ID NO: 1114 - protein, 16 aa, Homo sapiens
LKVEDPFYWVSPGVLV

SEQ ID NO: 1115 - protein, 16 aa, Homo sapiens
LLAVLPVLLLQITVGL

SEQ ID NO: 1116 - protein, 16 aa, Homo sapiens
LLQITVGLVFLCLQYR

SEQ ID NO: 1117 - protein, 16 aa, Homo sapiens
LPVLLLQITVGLVFLC

SEQ ID NO: 1118 - protein, 16 aa, Homo sapiens
LQYRLRGKLRAEIENL

SEQ ID NO: 1119 - protein, 16 aa, Homo sapiens
LRAEIENLHRTFDPHF

SEQ ID NO: 1120 - protein, 16 aa, Homo sapiens
LRGKLRAEIENLHRTF

SEQ ID NO: 1121 - protein, 16 aa, Homo sapiens
LRVPCWKITLFVIVPV

SEQ ID NO: 1122 - protein, 9 aa, Homo sapiens
LVFLCLQYR

SEQ ID NO: 1123 - protein, 16 aa, Homo sapiens
NGKDQDGDQAPEYRGR

SEQ ID NO: 1124 - protein, 16 aa, Homo sapiens
QAPEYRGRTELLKDAI

SEQ ID NO: 1125 - protein, 16 aa, Homo sapiens
QDGDQAPEYRGRTELL

SEQ ID NO: 1126 - protein, 9 aa, Homo sapiens
QYRLRGKLR

SEQ ID NO: 1127 - protein, 16 aa, Homo sapiens
RALVGDEVELPCRISP

SEQ ID NO: 1128 - protein, 16 aa, Homo sapiens
RDHSYQEEAAMELKVE

SEQ ID NO: 1129 - protein, 16 aa, Homo sapiens
RFSDEGGFTCFFRDHS

SEQ ID NO: 1130 - protein, 16 aa, Homo sapiens
RHPIRALVGDEVELPC

SEQ ID NO: 1131 - protein, 16 aa, Homo sapiens
RISPGKNATGMEVGWY

SEQ ID NO: 1132 - protein, 14 aa, Homo sapiens
RLAGQFLEELRNPF

SEQ ID NO: 1133 - protein, 9 aa, Homo sapiens
RLRGKLRAE

SEQ ID NO: 1134 - protein, 16 aa, Homo sapiens
RPPFSRVVHLYRNGKD

SEQ ID NO: 1135 - protein, 16 aa, Homo sapiens
SRVVHLYRNGKDQDGD

SEQ ID NO: 1136 - protein, 16 aa, Homo sapiens
TCFFRDHSYQEEAAME

SEQ ID NO: 1137 - protein, 16 aa, Homo sapiens
TELLKDAIGEGKVTLR

SEQ ID NO: 1138 - protein, 16 aa, Homo sapiens
TGMEVGWYRPPFSRVV

SEQ ID NO: 1139 - protein, 16 aa, Homo sapiens
TLFVIVPVLGPLVALI

SEQ ID NO: 1140 - protein, 21 aa, unidentified
  REGION 1..21: note = epitope involved in multiple sclerosis
TPRVERNGHSVFLAPYGWMVK

SEQ ID NO: 1141 - protein, 21 aa, unidentified
  REGION 1..21: note = epitope involved in multiple sclerosis
TPRVERNGHSVFLAPYGWMVK

SEQ ID NO: 1142 - protein, 16 aa, Homo sapiens
TVGLVFLCLQYRLRGK

SEQ ID NO: 1143 - protein, 16 aa, Homo sapiens
VALIICYNWLHRRLAG

SEQ ID NO: 1144 - protein, 9 aa, Homo sapiens
VFLCLQYRL

SEQ ID NO: 1145 - protein, 9 aa, Homo sapiens
VGLVFLCLQ

SEQ ID NO: 1146 - protein, 16 aa, Homo sapiens
VGWYRPPFSRVVHLYR

SEQ ID NO: 1147 - protein, 16 aa, Homo sapiens
VIGPRHPIRALVGDEV

SEQ ID NO: 1148 - protein, 16 aa, Homo sapiens
VTLRIRNVRFSDEGGF

SEQ ID NO: 1149 - protein, 16 aa, Homo sapiens
WLHRRLAGQFLEELRN

SEQ ID NO: 1150 - protein, 16 aa, Homo sapiens
WVSPGVLVLLAVLPVL

SEQ ID NO: 1151 - protein, 16 aa, Homo sapiens
YQEEAAMELKVEDPFY

SEQ ID NO: 1152 - protein, 16 aa, Homo sapiens
YRGRTELLKDAIGEGK

SEQ ID NO: 1153 - protein, 9 aa, Homo sapiens
YRLRGKLRA

SEQ ID NO: 1154 - protein, 21 aa, Human herpesvirus
AGAGGGAGGAGAGGGAGGAGG

SEQ ID NO: 1155 - protein, 28 aa, Human herpesvirus
DGEPDVPPGAIEQGPADDPGEGPSTGPR

SEQ ID NO: 1156 - protein, 22 aa, Human herpesvirus
GGSGGRRGRGRERARGGSRERA

SEQ ID NO: 1157 - protein, 26 aa, Human herpesvirus
GVFVYGGSKTSLYNLRRGTALAIPQC

SEQ ID NO: 1158 - protein, 26 aa, Human herpesvirus
KFENIAEGLRALLARSHVERTTDEGT

SEQ ID NO: 1159 - protein, 27 aa, Human herpesvirus
KKGGWFGKHRGQGGSNPKFENIAEGLR

SEQ ID NO: 1160 - protein, 44 aa, Human herpesvirus
MSDEGPGTGPGNGLGEKGDTSGPEGSGGSGPQRRGGDNHGRGRG

SEQ ID NO: 1161 - protein, 27 aa, Human herpesvirus
PPRRPPPGRRPFFHPVGEADYFEYHQE

SEQ ID NO: 1162 - protein, 28 aa, Human herpesvirus
PRGQGDGGRRKKGGWFGKHRGQGGSNPK

SEQ ID NO: 1163 - protein, 26 aa, Human herpesvirus
QGPADDPGEGPSTGPRGQGDGGRRKK

SEQ ID NO: 1164 - protein, 20 aa, Human herpesvirus
RERARGGSRERARGRGRGRG

SEQ ID NO: 1165 - protein, 149 aa, Human herpesvirus
RKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLP

SEQ ID NO: 1166 - protein, 28 aa, Human herpesvirus
VEGAAAEGDDGDDGDEGGDGDEGEEGQE

SEQ ID NO: 1167 - protein, 20 aa, Homo sapiens
AVIMGNWENHWIYWVGPIIG

SEQ ID NO: 1168 - protein, 20 aa, Homo sapiens
AVLAGGLYEYVFCPDVEFKR

SEQ ID NO: 1169 - protein, 20 aa, Homo sapiens
DLILKPGVVHVIDVDRGEEK

SEQ ID NO: 1170 - protein, 20 aa, Homo sapiens
EDNRSQVETDDLILKPGVVH

SEQ ID NO: 1171 - protein, 20 aa, Homo sapiens
GILYLVTPPSVVGGLGVTMV

SEQ ID NO: 1172 - protein, 20 aa, Homo sapiens
GKCGPLCTRENIMVAFKGVW

SEQ ID NO: 1173 - protein, 20 aa, Homo sapiens
GTEKPLPVDMVLISLCFGLS

SEQ ID NO: 1174 - protein, 20 aa, Homo sapiens
HGNLTAGHGLLVELIITFQL

SEQ ID NO: 1175 - protein, 20 aa, Homo sapiens
HLFAINYTGASMNPARSFGP

SEQ ID NO: 1176 - protein, 20 aa, Homo sapiens
IATMVQCFGHISGGHINPAV

SEQ ID NO: 1177 - protein, 20 aa, Homo sapiens
ISGGHINPAVTVAMVCTRKI

SEQ ID NO: 1178 - protein, 20 aa, Homo sapiens
KRTDVTGSIALAIGFSVAIG

SEQ ID NO: 1179 - protein, 20 aa, Homo sapiens
LSLGSTINWGGTEKPLPVDM

SEQ ID NO: 1180 - protein, 20 aa, Homo sapiens
MSDRPTARRWGKCGPLCTRE

SEQ ID NO: 1181 - protein, 20 aa, Homo sapiens
NIMVAFKGVWTQAFWKAVTA

SEQ ID NO: 1182 - protein, 20 aa, Homo sapiens
QQTKGSYMEVEDNRSQVETD

SEQ ID NO: 1183 - protein, 20 aa, Homo sapiens
RFKEAFSKAAQQTKGSYMEV

SEQ ID NO: 1184 - protein, 20 aa, Homo sapiens
SIAKSVFYIAAQCLGAIIGA

SEQ ID NO: 1185 - protein, 20 aa, Homo sapiens
SMNPARSFGPAVIMGNWENH

SEQ ID NO: 1186 - protein, 20 aa, Homo sapiens
TQAFWKAVTAEFLAMLIFVL

SEQ ID NO: 1187 - protein, 20 aa, Homo sapiens
TVAMVCTRKISIAKSVFYIA

SEQ ID NO: 1188 - protein, 20 aa, Homo sapiens
VFCPDVEFKRRFKEAFSKAA

SEQ ID NO: 1189 - protein, 20 aa, Homo sapiens
VFTIFASCDSKRTDVTGSIA

SEQ ID NO: 1190 - protein, 20 aa, Homo sapiens
VVGGLGVTMVHGNLTAGHGL

SEQ ID NO: 1191 - protein, 20 aa, Homo sapiens
WIYWVGPIIGAVLAGGLYEY

SEQ ID NO: 1192 - protein, 19 aa, Homo sapiens
NATGMEVGWYRPPFSRVVH

SEQ ID NO: 1193 - protein, 12 aa, Homo sapiens
RALVGDEVELPC

SEQ ID NO: 1194 - protein, 21 aa, unidentified
  REGION 1..21: note = epitope involved in multiple sclerosis
TPRVERFGHSVFLAPYGWMVK

SEQ ID NO: 1195 - protein, 21 aa, unidentified
  REGION 1..21: note = epitope involved in multiple sclerosis
TPRVERGGHSVFLAPYGWMVK

SEQ ID NO: 1196 - protein, 21 aa, unidentified
  REGION 1..21: note = epitope involved in multiple sclerosis
TPRVERQGHSVFLAPYGWMVK

SEQ ID NO: 1197 - protein, 15 aa, Homo sapiens
EKKGKDQSGEVLSSV

SEQ ID NO: 1198 - protein, 24 aa, Homo sapiens
FCPDVEFKRRFKEAFSKAAQQTKG

SEQ ID NO: 1199 - protein, 12 aa, unidentified
  REGION 1..12: note = epitope involved in multiple sclerosis
DPGQLRLWRLAS

SEQ ID NO: 1200 - protein, 12 aa, unidentified
  REGION 1..12: note = epitope involved in multiple sclerosis
FHQPTYDYTVSR

SEQ ID NO: 1201 - protein, 12 aa, unidentified
  REGION 1..12: note = epitope involved in multiple sclerosis
FSKTEPLSPSWF

SEQ ID NO: 1202 - protein, 12 aa, unidentified
  REGION 1..12: note = epitope involved in multiple sclerosis
GTWICDFKSCSW

SEQ ID NO: 1203 - protein, 12 aa, unidentified
  REGION 1..12: note = epitope involved in multiple sclerosis
HIDVSRPWRVTG

SEQ ID NO: 1204 - protein, 12 aa, unidentified
  REGION 1..12: note = epitope involved in multiple sclerosis
HWRHWLADTAFP

SEQ ID NO: 1205 - protein, 12 aa, unidentified
  REGION 1..12: note = epitope involved in multiple sclerosis
HYNPWEQEPMMY

SEQ ID NO: 1206 - protein, 12 aa, unidentified
  REGION 1..12: note = epitope involved in multiple sclerosis
NALTESKYVKLL

SEQ ID NO: 1207 - protein, 12 aa, unidentified
  REGION 1..12: note = epitope involved in multiple sclerosis
NCAFWLGKLYCR

SEQ ID NO: 1208 - protein, 12 aa, Homo sapiens
NCSWCHVLQRCS

SEQ ID NO: 1209 - protein, 10 aa, Prochlorococcus marinus
NCWKPQVLHC

SEQ ID NO: 1210 - protein, 12 aa, unidentified
  REGION 1..12: note = epitope involved in multiple sclerosis
NNLTQSKFLRLQ

SEQ ID NO: 1211 - protein, 12 aa, unidentified
  REGION 1..12: note = epitope involved in multiple sclerosis
NNPAPVYTHRVL

SEQ ID NO: 1212 - protein, 12 aa, unidentified
  REGION 1..12: note = epitope involved in multiple sclerosis
NPVEHWLAVLPT

SEQ ID NO: 1213 - protein, 12 aa, unidentified
  REGION 1..12: note = epitope involved in multiple sclerosis
NYPSWLHAYRLA

SEQ ID NO: 1214 - protein, 12 aa, unidentified
  REGION 1..12: note = epitope involved in multiple sclerosis
QHNVSRPWVLFT

SEQ ID NO: 1215 - protein, 12 aa, unidentified
  REGION 1..12: note = epitope involved in multiple sclerosis
SCNYHGRTLTCW

SEQ ID NO: 1216 - protein, 12 aa, unidentified
  REGION 1..12: note = epitope involved in multiple sclerosis
SCNYHHTYLTCW

SEQ ID NO: 1217 - protein, 12 aa, unidentified
  REGION 1..12: note = epitope involved in multiple sclerosis
SCQLVRTIWSCS

SEQ ID NO: 1218 - protein, 12 aa, unidentified
  REGION 1..12: note = epitope involved in multiple sclerosis
SLGSKMDISRPW

SEQ ID NO: 1219 - protein, 12 aa, unidentified
  REGION 1..12: note = epitope involved in multiple sclerosis
STLSESKVNRLL

SEQ ID NO: 1220 - protein, 12 aa, unidentified
  REGION 1..12: note = epitope involved in multiple sclerosis
TAQDISRPWWFP

SEQ ID NO: 1221 - protein, 12 aa, unidentified
  REGION 1..12: note = epitope involved in multiple sclerosis
TIMDISRTWTKV

SEQ ID NO: 1222 - protein, 12 aa, unidentified
  REGION 1..12: note = epitope involved in multiple sclerosis
TNTLTPHKLQML

SEQ ID NO: 1223 - protein, 12 aa, unidentified
  REGION 1..12: note = epitope involved in multiple sclerosis
TPQQDLYDIMYD

SEQ ID NO: 1224 - protein, 12 aa, unidentified
  REGION 1..12: note = epitope involved in multiple sclerosis
TQGLKYWYPVWS

SEQ ID NO: 1225 - protein, 12 aa, unidentified
  REGION 1..12: note = epitope involved in multiple sclerosis
VPQKYWWLSDHT

SEQ ID NO: 1226 - protein, 12 aa, unidentified
  REGION 1..12: note = epitope involved in multiple sclerosis
VVPKYWWSAELP

SEQ ID NO: 1227 - protein, 12 aa, unidentified
  REGION 1..12: note = epitope involved in multiple sclerosis
WHWRQPTWLQVI

SEQ ID NO: 1228 - protein, 11 aa, Homo sapiens
FFRDHSYQEEA

SEQ ID NO: 1229 - protein, 11 aa, unidentified
  REGION 1..11: note = epitope involved in multiple sclerosis
FFRDHSYQSEA

SEQ ID NO: 1230 - protein, 7 aa, unidentified
  REGION 1..7: note = epitope involved in multiple sclerosis
APAHHPP

SEQ ID NO: 1231 - protein, 7 aa, unidentified
  REGION 1..7: note = epitope involved in multiple sclerosis
APAHQIP

SEQ ID NO: 1232 - protein, 7 aa, unidentified
  REGION 1..7: note = epitope involved in multiple sclerosis
APPHLPP

SEQ ID NO: 1233 - protein, 7 aa, unidentified
  REGION 1..7: note = epitope involved in multiple sclerosis
APPHQMP

SEQ ID NO: 1234 - protein, 7 aa, unidentified
  REGION 1..7: note = epitope involved in multiple sclerosis
APPHVMP

SEQ ID NO: 1235 - protein, 7 aa, unidentified
  REGION 1..7: note = epitope involved in multiple sclerosis
APSHPPP

SEQ ID NO: 1236 - protein, 7 aa, unidentified
  REGION 1..7: note = epitope involved in multiple sclerosis
EFGTFLW

SEQ ID NO: 1237 - protein, 6 aa, unidentified
  REGION 1..6: note = epitope involved in multiple sclerosis
FGTYLW

SEQ ID NO: 1238 - protein, 7 aa, unidentified
  REGION 1..7: note = epitope involved in multiple sclerosis
FHLPWMQ

SEQ ID NO: 1239 - protein, 7 aa, unidentified
  REGION 1..7: note = epitope involved in multiple sclerosis
GPVNMNL

SEQ ID NO: 1240 - protein, 7 aa, unidentified
  REGION 1..7: note = epitope involved in multiple sclerosis
GRQAQYY

SEQ ID NO: 1241 - protein, 11 aa, Human herpesvirus
GRRPFFHPVGE

SEQ ID NO: 1242 - protein, 7 aa, unidentified
  REGION 1..7: note = epitope involved in multiple sclerosis
ILNWHQF

SEQ ID NO: 1243 - protein, 7 aa, unidentified
  REGION 1..7: note = epitope involved in multiple sclerosis
KFGTALW

SEQ ID NO: 1244 - protein, 7 aa, unidentified
  REGION 1..7: note = epitope involved in multiple sclerosis
KWPIIDT

SEQ ID NO: 1245 - protein, 6 aa, unidentified
  REGION 1..6: note = epitope involved in multiple sclerosis
LNWNPF

SEQ ID NO: 1246 - protein, 7 aa, unidentified
  REGION 1..7: note = epitope involved in multiple sclerosis
MFNWHPF

SEQ ID NO: 1247 - protein, 7 aa, unidentified
  REGION 1..7: note = epitope involved in multiple sclerosis
MQAHQTK

SEQ ID NO: 1248 - protein, 7 aa, unidentified
  REGION 1..7: note = epitope involved in multiple sclerosis
PLELSVY

SEQ ID NO: 1249 - protein, 7 aa, unidentified
  REGION 1..7: note = epitope involved in multiple sclerosis
PVELQLY

SEQ ID NO: 1250 - protein, 7 aa, unidentified
  REGION 1..7: note = epitope involved in multiple sclerosis
PVGPWTN

SEQ ID NO: 1251 - protein, 7 aa, unidentified
  REGION 1..7: note = epitope involved in multiple sclerosis
QFGTFLW

SEQ ID NO: 1252 - protein, 8 aa, Homo sapiens
SFDGTFLW

SEQ ID NO: 1253 - protein, 7 aa, unidentified
  REGION 1..7: note = epitope involved in multiple sclerosis
SFGTALW

SEQ ID NO: 1254 - protein, 7 aa, unidentified
  REGION 1..7: note = epitope involved in multiple sclerosis
SFGTFLW

SEQ ID NO: 1255 - protein, 7 aa, unidentified
  REGION 1..7: note = epitope involved in multiple sclerosis
SFGTILW

SEQ ID NO: 1256 - protein, 7 aa, unidentified
  REGION 1..7: note = epitope involved in multiple sclerosis
SHRPTTQ

SEQ ID NO: 1257 - protein, 7 aa, unidentified
  REGION 1..7: note = epitope involved in multiple sclerosis
SQSVAAS

SEQ ID NO: 1258 - protein, 7 aa, unidentified
  REGION 1..7: note = epitope involved in multiple sclerosis
STEGRHN

SEQ ID NO: 1259 - protein, 7 aa, unidentified
  REGION 1..7: note = epitope involved in multiple sclerosis
TVQPQFH

SEQ ID NO: 1260 - protein, 7 aa, unidentified
  REGION 1..7: note = epitope involved in multiple sclerosis
TYMVPAP

SEQ ID NO: 1261 - protein, 8 aa, unidentified
  REGION 1..8: note = epitope involved in multiple sclerosis
VLNRWNPF

SEQ ID NO: 1262 - protein, 7 aa, unidentified
  REGION 1..7: note = epitope involved in multiple sclerosis
VLNWHPF

SEQ ID NO: 1263 - protein, 7 aa, unidentified
  REGION 1..7: note = epitope involved in multiple sclerosis
WGLDNPP

SEQ ID NO: 1264 - protein, 7 aa, unidentified
  REGION 1..7: note = epitope involved in multiple sclerosis
WYYKPPA

SEQ ID NO: 1265 - protein, 9 aa, Human herpesvirus
RPRTPPPSY

SEQ ID NO: 1266 - protein, 8 aa, Homo sapiens
TPRTPPPQ

SEQ ID NO: 1267 - protein, 13 aa, Homo sapiens
FSWGAEGQRPGFG

SEQ ID NO: 1268 - protein, 25 aa, Homo sapiens
SIAFPSKTSASIGSLCADARMYGVL

SEQ ID NO: 1269 - protein, 17 aa, Homo sapiens
SLCFGLSIATMVQCFGH

SEQ ID NO: 1270 - protein, 18 aa, Homo sapiens
VIDVDRGEEKKGKDQSGE

SEQ ID NO: 1271 - protein, 11 aa, Homo sapiens
GDEVELPCRIS

SEQ ID NO: 1272 - protein, 14 aa, Homo sapiens
LTVGLTRRGQPRQY

SEQ ID NO: 1273 - protein, 14 aa, Homo sapiens
LTVGLTRRGQPRQY

SEQ ID NO: 1274 - protein, 13 aa, Homo sapiens
YNQYSQRYHQRTN

SEQ ID NO: 1275 - protein, 13 aa, Homo sapiens
YNQYSQRYHQRTN

SEQ ID NO: 1276 - protein, 21 aa, Homo sapiens
GITVSRNGSSVFTTSQDSTLK

SEQ ID NO: 1277 - protein, 21 aa, unidentified
  REGION 1..21: note = epitope involved in multiple sclerosis
TCFFRDGNYQEEAAMELKVED

SEQ ID NO: 1278 - protein, 19 aa, Homo sapiens
TFRDLGNLTHLFLHGNRIS

SEQ ID NO: 1279 - protein, 21 aa, unidentified
  REGION 1..21: note = epitope involved in multiple sclerosis
TFRVLRNGTSVFLHPNKWTVK

SEQ ID NO: 1280 - protein, 19 aa, Homo sapiens
TLINLTNLTHLYLHNNKFT

SEQ ID NO: 1281 - protein, 21 aa, Homo sapiens
VVHLYRNGKDQDGDQAPEYRG

SEQ ID NO: 1282 - protein, 11 aa, Homo sapiens
ERLGPLVEQGR

SEQ ID NO: 1283 - protein, 15 aa, Homo sapiens
KLTSEARGRIPVAQK

SEQ ID NO: 1284 - protein, 27 aa, Homo sapiens
MKILTERGYSFTTTAEREIVRDIKEKL

SEQ ID NO: 1285 - protein, 15 aa, Homo sapiens
AHYGSLPQKSHGRTQ

SEQ ID NO: 1286 - protein, 15 aa, Homo sapiens
DPVVHFFKNIVTPRT

SEQ ID NO: 1287 - protein, 16 aa, Homo sapiens
GKGRGLSLSRFSWGAE

SEQ ID NO: 1288 - protein, 7 aa, Homo sapiens
GLQLYFS

SEQ ID NO: 1289 - protein, 15 aa, Homo sapiens
GQRPGFGYGGRASDY

SEQ ID NO: 1290 - protein, 15 aa, Homo sapiens
ILDSIGRFFGGDRGA

SEQ ID NO: 1291 - protein, 15 aa, Homo sapiens
PKRGSGKDSHHPART

SEQ ID NO: 1292 - protein, 21 aa, Homo sapiens
YLASASTMDHARHGFLPRRHR

SEQ ID NO: 1293 - protein, 26 aa, Zea mays
FTGASMNPARSFGPALATGDWTNHWV

SEQ ID NO: 1294 - protein, 26 aa, Homo sapiens
YTGASMNPARSFGPAVIMGNWENHWI

SEQ ID NO: 1295 - protein, 20 aa, Triticum aestivum
AMCNVYIPPYCAMAPFGIFG

SEQ ID NO: 1296 - protein, 8 aa, Triticum aestivum
ELPYPQPQ

SEQ ID NO: 1297 - protein, 8 aa, Triticum aestivum
FPQPELPY

SEQ ID NO: 1298 - protein, 10 aa, Triticum aestivum
FPQPQPFPPQ

SEQ ID NO: 1299 - protein, 10 aa, Triticum aestivum
FPQPQQQFPQ

SEQ ID NO: 1300 - protein, 13 aa, Triticum aestivum
FPQQPQQPFPQQP

SEQ ID NO: 1301 - protein, 12 aa, Triticum aestivum
FPQQPQQPYPQQ

SEQ ID NO: 1302 - protein, 13 aa, Triticum aestivum
FPQQPQQPYPQQP

SEQ ID NO: 1303 - protein, 13 aa, Triticum aestivum
FPQQPQQPYPQQP

SEQ ID NO: 1304 - protein, 15 aa, Triticum aestivum
FPQQPQQPYPQQPQQ

SEQ ID NO: 1305 - protein, 10 aa, Triticum aestivum
FPSQQPYLQL

SEQ ID NO: 1306 - protein, 12 aa, unidentified
  REGION 1..12: note = epitope involved in celiac disease
FSQPEQEFPQPQ

SEQ ID NO: 1307 - protein, 12 aa, Triticum aestivum
FSQPQQQFPQPQ

SEQ ID NO: 1308 - protein, 11 aa, unidentified
  REGION 1..11: note = eptiope involved in celiac disease
GIIQPEQPAQL

SEQ ID NO: 1309 - protein, 11 aa, Triticum aestivum
GIIQPQQPAQL

SEQ ID NO: 1310 - protein, 15 aa, Triticum aestivum
GSFQPSQQNPQAQGS

SEQ ID NO: 1311 - protein, 20 aa, Triticum aestivum
HQPQQTFPQPQQTYPHQPQQ

SEQ ID NO: 1312 - protein, 20 aa, Triticum aestivum
IHSVAHSIIMQQEQQQGVPI

SEQ ID NO: 1313 - protein, 10 aa, unidentified
  REGION 1..10: note = epitope involved in celiac disease
IIQPEQPAQL

SEQ ID NO: 1314 - protein, 9 aa, Triticum aestivum
IIQPQQPAQ

SEQ ID NO: 1315 - protein, 10 aa, Triticum aestivum
IIQPQQPAQL

SEQ ID NO: 1316 - protein, 20 aa, Triticum aestivum
LGIIQPQQPAQLEGIRSLVL

SEQ ID NO: 1317 - protein, 12 aa, Triticum aestivum
LGQGSFRPSQQN

SEQ ID NO: 1318 - protein, 17 aa, Triticum aestivum
LGQQQPFPPQQPYPQPQ

SEQ ID NO: 1319 - protein, 19 aa, Triticum aestivum
LGQQQPFPPQQPYPQPQPF

SEQ ID NO: 1320 - protein, 20 aa, unidentified
  REGION 1..20: note = epitope involved in celiac disease
LQLQPFPQPEKPYPQPEKPY

SEQ ID NO: 1321 - protein, 20 aa, unidentified
  REGION 1..20: note = epitope involved in celiac disease
LQLQPFPQPEKPYPQPELPY

SEQ ID NO: 1322 - protein, 20 aa, unidentified
  REGION 1..20: note = epitope involved in celiac disease
LQLQPFPQPEKPYPQPELPY

SEQ ID NO: 1323 - protein, 20 aa, unidentified
  REGION 1..20: note = epitope involved in celiac disease
LQLQPFPQPELPYPQPEKPY

SEQ ID NO: 1324 - protein, 20 aa, unidentified
  REGION 1..20: note = epitope involved in celiac disease
LQLQPFPQPELPYPQPELPY

SEQ ID NO: 1325 - protein, 33 aa, unidentified
  REGION 1..33: note = epitope involved in celiac disease
LQLQPFPQPELPYPQPELPYPQPELPYPQPQPF

SEQ ID NO: 1326 - protein, 13 aa, Triticum aestivum
LQLQPFPQPQLPY

SEQ ID NO: 1327 - protein, 13 aa, Triticum aestivum
LQLQPFPQPQLPY

SEQ ID NO: 1328 - protein, 20 aa, Triticum aestivum
LQLQPFPQPQLPYPQPQLPY

SEQ ID NO: 1329 - protein, 20 aa, Triticum aestivum
LQLQPFPQPQLPYPQPQLPY

SEQ ID NO: 1330 - protein, 32 aa, unidentified
  REGION 1..32: note = epitope involved in celiac disease
LQLQPFPQPQLPYPQPQLPYPQPQLPYPQPPF

SEQ ID NO: 1331 - protein, 33 aa, Triticum aestivum
LQLQPFPQPQLPYPQPQLPYPQPQLPYPQPQPF

SEQ ID NO: 1332 - protein, 8 aa, Triticum aestivum
LQPFPQPE

SEQ ID NO: 1333 - protein, 11 aa, unidentified
  REGION 1..11: note = epitope involved in celiac disease
LQPFPQPELPY

SEQ ID NO: 1334 - protein, 11 aa, Triticum aestivum
LQPFPQPQLPY

SEQ ID NO: 1335 - protein, 20 aa, Triticum aestivum
LQPQQPFPQQPQQPYPQQPQ

SEQ ID NO: 1336 - protein, 20 aa, Triticum aestivum
LRPLFQLAQGLGIIQPQQPA

SEQ ID NO: 1337 - protein, 12 aa, Human adenovirus 12
LRRGMFRPSQCN

SEQ ID NO: 1338 - protein, 8 aa, Triticum aestivum
PELPYPQP

SEQ ID NO: 1339 - protein, 14 aa, unidentified
  REGION 1..14: note = epitope involved in celiac disease
PEQPQQSFPEQERP

SEQ ID NO: 1340 - protein, 8 aa, Triticum aestivum
PFPQPELP

SEQ ID NO: 1341 - protein, 9 aa, Triticum aestivum
PFPQPQLPY

SEQ ID NO: 1342 - protein, 15 aa, Triticum aestivum
PFPQPQLPYPQPQLP

SEQ ID NO: 1343 - protein, 20 aa, Triticum aestivum
PFPQPQQTFPQQPQLPFPQQ

SEQ ID NO: 1344 - protein, 20 aa, Triticum aestivum
PFPQQPQQPFPQQPQQSFPQ

SEQ ID NO: 1345 - protein, 14 aa, Triticum aestivum
PFRPQQPYPQPQPQ

SEQ ID NO: 1346 - protein, 8 aa, Triticum aestivum
PFSQQQQQ

SEQ ID NO: 1347 - protein, 10 aa, Triticum aestivum
PFSQQQQSPF

SEQ ID NO: 1348 - protein, 20 aa, Triticum aestivum
PFTQPQQPTPIQPQQPFPQQ

SEQ ID NO: 1349 - protein, 8 aa, Triticum aestivum
PQPELPYP

SEQ ID NO: 1350 - protein, 9 aa, unidentified
  REGION 1..9: note = epitope involved in celiac disease
PQPELPYPQ

SEQ ID NO: 1351 - protein, 11 aa, unidentified
  REGION 1..11: note = epitope involved in celiac disease
PQPELPYPQPE

SEQ ID NO: 1352 - protein, 14 aa, unidentified
  REGION 1..14: note = epitope involved in celiac disease
PQPELPYPQPELPY

SEQ ID NO: 1353 - protein, 14 aa, unidentified
  REGION 1..14: note = epitope involved in celiac disease
PQPELPYPQPQLPY

SEQ ID NO: 1354 - protein, 9 aa, Triticum aestivum
PQPQLPYPQ

SEQ ID NO: 1355 - protein, 12 aa, Triticum aestivum
PQPQLPYPQPQL

SEQ ID NO: 1356 - protein, 14 aa, Triticum aestivum
PQPQLPYPQPQLPY

SEQ ID NO: 1357 - protein, 14 aa, Triticum aestivum
PQPQLPYPQPQLPY

SEQ ID NO: 1358 - protein, 14 aa, Triticum aestivum
PQPQLPYPQPQLPY

SEQ ID NO: 1359 - protein, 20 aa, Triticum aestivum
PQPQQPQLPFPQQPQQPFPQ

SEQ ID NO: 1360 - protein, 5 aa, Triticum aestivum
PQQPF

SEQ ID NO: 1361 - protein, 20 aa, Triticum aestivum
PQQPFPQPQQPQQPFPQSQQ

SEQ ID NO: 1362 - protein, 20 aa, Triticum aestivum
PQQPFPQPQQQFPQPQQPQQ

SEQ ID NO: 1363 - protein, 11 aa, Triticum aestivum
PQQPFPQQPQQ

SEQ ID NO: 1364 - protein, 11 aa, Triticum aestivum
PQQPFPQQPQQ

SEQ ID NO: 1365 - protein, 17 aa, Triticum aestivum
PQQPFPQQPQQPYPQQP

SEQ ID NO: 1366 - protein, 20 aa, Triticum aestivum
PQQPFPQSQQPQQPFPQPQQ

SEQ ID NO: 1367 - protein, 20 aa, Triticum aestivum
PQQPQQPFPLQPQQPFPQQP

SEQ ID NO: 1368 - protein, 14 aa, Triticum aestivum
PQQPQQSFPQQQRP

SEQ ID NO: 1369 - protein, 14 aa, Triticum aestivum
PQQPQQSFPQQQRP

SEQ ID NO: 1370 - protein, 9 aa, Triticum aestivum
PQQSFPEQE

SEQ ID NO: 1371 - protein, 9 aa, Triticum aestivum
PQQSFPQQQ

SEQ ID NO: 1372 - protein, 14 aa, Triticum aestivum
PQTQQPQQPFPQPQ

SEQ ID NO: 1373 - protein, 15 aa, Triticum aestivum
PSGQGSFQPSQQNPQ

SEQ ID NO: 1374 - protein, 9 aa, Triticum aestivum
PYPQPQLPY

SEQ ID NO: 1375 - protein, 9 aa, Triticum aestivum
PYPQPQLPY

SEQ ID NO: 1376 - protein, 15 aa, Triticum aestivum
QAQGSVQPQQLPQFE

SEQ ID NO: 1377 - protein, 20 aa, Triticum aestivum
QFPQPQQPQQSFPQQQQPAI

SEQ ID NO: 1378 - protein, 20 aa, Triticum aestivum
QFPQTQQPQQPFPQPQQTFP

SEQ ID NO: 1379 - protein, 10 aa, Triticum aestivum
QFQGQQQPFP

SEQ ID NO: 1380 - protein, 15 aa, Aegilops markgrafii
QGQQGYYPTSPQQSG

SEQ ID NO: 1381 - protein, 10 aa, Triticum aestivum
QGQQQPFPPQ

SEQ ID NO: 1382 - protein, 10 aa, Triticum aestivum
QLIPCMDVVL

SEQ ID NO: 1383 - protein, 13 aa, Triticum aestivum
QLPYPQPQLPYPQ

SEQ ID NO: 1384 - protein, 15 aa, Triticum aestivum
QLPYPQPQLPYPQPQ

SEQ ID NO: 1385 - protein, 8 aa, Triticum aestivum
QLQPFPQP

SEQ ID NO: 1386 - protein, 12 aa, Triticum aestivum
QLQPFPQPELPY

SEQ ID NO: 1387 - protein, 17 aa, Triticum aestivum
QLQPFPQPELPYPQPQS

SEQ ID NO: 1388 - protein, 17 aa, Triticum aestivum
QLQPFPQPELPYPQPQS

SEQ ID NO: 1389 - protein, 12 aa, Triticum aestivum
QLQPFPQPQLPY

SEQ ID NO: 1390 - protein, 12 aa, Triticum aestivum
QLQPFPQPQLPY

SEQ ID NO: 1391 - protein, 16 aa, Triticum aestivum
QLQPFPQPQLPYPQPQ

SEQ ID NO: 1392 - protein, 17 aa, Triticum aestivum
QLQPFPQPQLPYPQPQL

SEQ ID NO: 1393 - protein, 17 aa, Triticum aestivum
QLQPFPQPQLPYPQPQP

SEQ ID NO: 1394 - protein, 17 aa, Triticum aestivum
QLQPFPQPQLPYPQPQS

SEQ ID NO: 1395 - protein, 8 aa, Triticum aestivum
QPELPYPQ

SEQ ID NO: 1396 - protein, 8 aa, Triticum aestivum
QPFPQPEL

SEQ ID NO: 1397 - protein, 10 aa, unidentified
  REGION 1..10: note = epitope involved in celiac disease
QPFPQPELPY

SEQ ID NO: 1398 - protein, 10 aa, Triticum aestivum
QPFPQPQLPY

SEQ ID NO: 1399 - protein, 10 aa, Triticum aestivum
QPFPSQQPYL

SEQ ID NO: 1400 - protein, 13 aa, Triticum aestivum
QPQLPFPQQPQQP

SEQ ID NO: 1401 - protein, 15 aa, Triticum aestivum
QPQLPYPQPQLPYPQ

SEQ ID NO: 1402 - protein, 10 aa, Triticum aestivum
QPQPFPPQLP

SEQ ID NO: 1403 - protein, 21 aa, Triticum aestivum
QPQPFPQQSEQSQQPFQPQPF

SEQ ID NO: 1404 - protein, 10 aa, Triticum aestivum
QPQPFPSQQP

SEQ ID NO: 1405 - protein, 20 aa, Triticum aestivum
QPQPFRPQQPYPQPQPQYSQ

SEQ ID NO: 1406 - protein, 10 aa, unidentified
  REGION 1..10: note = epitope involved in celiac disease
QPQPQFPEQQ

SEQ ID NO: 1407 - protein, 19 aa, Triticum aestivum
QPQQPFPQQPQQPYPQQPQ

SEQ ID NO: 1408 - protein, 13 aa, Triticum aestivum
QPQQPIPVQPQQS

SEQ ID NO: 1409 - protein, 20 aa, Triticum aestivum
QPQQPIPVQPQQSFPQQSQQ

SEQ ID NO: 1410 - protein, 20 aa, Triticum aestivum
QPQQPQQPFPQQQQPLIQPY

SEQ ID NO: 1411 - protein, 16 aa, Triticum aestivum
QPQQPQQSFPQQQRPF

SEQ ID NO: 1412 - protein, 20 aa, Triticum aestivum
QPQQQYPSGQGSFQPSQQNP

SEQ ID NO: 1413 - protein, 10 aa, Triticum aestivum
QPQQSFPQQQ

SEQ ID NO: 1414 - protein, 12 aa, Triticum aestivum
QPQQSFPQQQRP

SEQ ID NO: 1415 - protein, 10 aa, unidentified
  REGION 1..10: note = epitope involved in celiac disease
QPQQTFPEQA

SEQ ID NO: 1416 - protein, 10 aa, Triticum aestivum
QPYPQPQPQY

SEQ ID NO: 1417 - protein, 20 aa, Triticum aestivum
QQFLQPQQPFPQQPQQPYPQ

SEQ ID NO: 1418 - protein, 13 aa, Triticum aestivum
QQGYYPTSPQQSG

SEQ ID NO: 1419 - protein, 20 aa, Triticum aestivum
QQLPQPQQPQQSFPQQQRPF

SEQ ID NO: 1420 - protein, 20 aa, Triticum aestivum
QQPFCQQPQRTIPQPHQTFH

SEQ ID NO: 1421 - protein, 5 aa, Triticum aestivum
QQPFP

SEQ ID NO: 1422 - protein, 20 aa, Triticum aestivum
QQPFPQQPQQPFPQPQQPIP

SEQ ID NO: 1423 - protein, 20 aa, Triticum aestivum
QQPLPQPQQPQQPFPQSQQP

SEQ ID NO: 1424 - protein, 15 aa, Triticum aestivum
QQPPFSQQQQQPLPQ

SEQ ID NO: 1425 - protein, 10 aa, Triticum durum
QQPQDAVQPF

SEQ ID NO: 1426 - protein, 20 aa, Triticum aestivum
QQPQLPFPQQPQQPFPQPQQ

SEQ ID NO: 1427 - protein, 20 aa, Triticum aestivum
QQPYPQPQPFPSQQPYLQLQ

SEQ ID NO: 1428 - protein, 20 aa, Triticum aestivum
QQQFIQPQQPFPQQPQQTYP

SEQ ID NO: 1429 - protein, 10 aa, Triticum aestivum
QQQPFPPQQP

SEQ ID NO: 1430 - protein, 20 aa, Triticum aestivum
QQQQPPFSQQQQSPFSQQQQ

SEQ ID NO: 1431 - protein, 20 aa, Triticum aestivum
QQTYPHQPQQQFPQTQQPQQ

SEQ ID NO: 1432 - protein, 21 aa, Triticum aestivum
  SITE 3: note = misc_feature - Xaa can be any naturally occurring amino acid
  SITE 8: note = misc_feature - Xaa can be any naturally occurring amino acid
  SITE 14: note = misc_feature - Xaa can be any naturally occurring amino acid
QQXSQPQXPQQQQXPQQPQQF

SEQ ID NO: 1433 - protein, 19 aa, Triticum aestivum
QQYPLGQGSFRPSQQNPQA

SEQ ID NO: 1434 - protein, 12 aa, Triticum aestivum
QSEQSQQPFQPQ

SEQ ID NO: 1435 - protein, 20 aa, Triticum aestivum
QSFLQQQMNPCKNFLLQQCN

SEQ ID NO: 1436 - protein, 20 aa, Triticum aestivum
QTQQPQQPFPQQPQQPFPQT

SEQ ID NO: 1437 - protein, 20 aa, Triticum aestivum
QVPLVQQQQFLGQQQPFPPQ

SEQ ID NO: 1438 - protein, 9 aa, Triticum aestivum
  SITE 2: note = misc_feature - Xaa can be any naturally occurring amino acid
QXPQQPQQF

SEQ ID NO: 1439 - protein, 20 aa, Triticum aestivum
SFPQQQQPAIQSFLQQQMNP

SEQ ID NO: 1440 - protein, 10 aa, Triticum aestivum
SFQQPQQQYP

SEQ ID NO: 1441 - protein, 12 aa, Triticum aestivum
SGQGSFQPSQQN

SEQ ID NO: 1442 - protein, 14 aa, Triticum aestivum
SGQGSFQPSQQNPQ

SEQ ID NO: 1443 - protein, 20 aa, Triticum aestivum
SQQPYLQLQPFPQPQLPYSQ

SEQ ID NO: 1444 - protein, 20 aa, Triticum aestivum
TIPQPHQTFHHQPQQTFPQP

SEQ ID NO: 1445 - protein, 20 aa, Triticum aestivum
TPIQPQQPFPQQPQQPQQPF

SEQ ID NO: 1446 - protein, 15 aa, Triticum aestivum
VQGQGIIQPQQPAQL

SEQ ID NO: 1447 - protein, 20 aa, Triticum aestivum
VYIPPYCTIAPFGIFGTNYR

SEQ ID NO: 1448 - protein, 20 aa, Triticum aestivum
WPQQQPFPQPQQPFCQQPQR

SEQ ID NO: 1449 - protein, 15 aa, Triticum aestivum
YLQLQPFPQPQLPYP

SEQ ID NO: 1450 - protein, 15 aa, Triticum aestivum
YPQPQLPYPQPQPFR

SEQ ID NO: 1451 - protein, 10 aa, Triticum aestivum
YPQPQPFPSQ

SEQ ID NO: 1452 - protein, 15 aa, Triticum aestivum
YPSGQGSFQPSQQNP

SEQ ID NO: 1453 - protein, 21 aa, Triticum aestivum
YQQLPQPQQPQQSFPQQQRPF

SEQ ID NO: 1454 - protein, 14 aa, unidentified
  REGION 1..14: note = epitope involved in celiac disease
QLQPFPQPELPYPQ

SEQ ID NO: 1455 - protein, 11 aa, Triticum aestivum
GIIQPQQPAQL

SEQ ID NO: 1456 - protein, 9 aa, Triticum aestivum
IQPQQPAQL

SEQ ID NO: 1457 - protein, 15 aa, Triticum aestivum
QPQQPQQSFPQQQRP

SEQ ID NO: 1458 - protein, 9 aa, Triticum aestivum
QQPFPQQPQ

SEQ ID NO: 1459 - protein, 9 aa, Triticum aestivum
QQPQQPYPQ

SEQ ID NO: 1460 - protein, 9 aa, Triticum aestivum
SQPQQQFPQ

SEQ ID NO: 1461 - protein, 18 aa, Triticum aestivum
FLGQQQPFPPQQPYPQPQ

SEQ ID NO: 1462 - protein, 20 aa, Triticum aestivum
FPGQQQPFPPQQPYPQPQPF

SEQ ID NO: 1463 - protein, 12 aa, Triticum aestivum
LGQQQPFPPQQP

SEQ ID NO: 1464 - protein, 19 aa, Triticum aestivum
QFLGQQQPFPPQQPYPQPQ

SEQ ID NO: 1465 - protein, 18 aa, Triticum aestivum
QNPSQQQPQEQVPLVQQQ

SEQ ID NO: 1466 - protein, 19 aa, Triticum aestivum
VRVPVPQLQPQNPSQQQPQ

SEQ ID NO: 1467 - protein, 15 aa, Triticum aestivum
QPQQPQQSFPQQQRP

SEQ ID NO: 1468 - protein, 8 aa, Triticum aestivum
VRVPVPQL

SEQ ID NO: 1469 - protein, 20 aa, unidentified
  REGION 1..20: note = epitope involved in celiac disease
LQLQPFPQPELPYPQPELPY

SEQ ID NO: 1470 - protein, 11 aa, unidentified
  REGION 1..11: note = epitope involved in celiac disease
LQPFPQPELPY

SEQ ID NO: 1471 - protein, 14 aa, Avena sativa
QYQPYPEQQQPFVQ

SEQ ID NO: 1472 - protein, 19 aa, Avena sativa
SEQYQPYPEQQEPFVQQQQ

SEQ ID NO: 1473 - protein, 22 aa, Avena nuda
TTTVQYDPSEQYQPYPEQQEPF

SEQ ID NO: 1474 - protein, 22 aa, Avena sativa
TTTVQYNPSEQYQPYPEQQEPF

SEQ ID NO: 1475 - protein, 12 aa, Avena sativa
YQPYPEQQEPFV

SEQ ID NO: 1476 - protein, 17 aa, Triticum aestivum
FPQPQLPYPQPQSQVLQ

SEQ ID NO: 1477 - protein, 15 aa, Triticum aestivum
LQLQPFPQPQLPYPQ

SEQ ID NO: 1478 - protein, 10 aa, Homo sapiens
AAEKQMKDKQ

SEQ ID NO: 1479 - protein, 10 aa, unidentified
  REGION 1..10: note = epitope involved in celiac disease
AEDKEDDAED

SEQ ID NO: 1480 - protein, 10 aa, Homo sapiens
AKIDDPTDSK

SEQ ID NO: 1481 - protein, 10 aa, unidentified
  REGION 1..10: note = epitope involved in celiac disease
ASFAEAPFSN

SEQ ID NO: 1482 - protein, 10 aa, unidentified
  REGION 1..10: note = epitope involved in celiac disease
DAEDKDEDEE

SEQ ID NO: 1483 - protein, 10 aa, Homo sapiens
DEEDKEEDEE

SEQ ID NO: 1484 - protein, 10 aa, unidentified
  REGION 1..10: note = epitope involved in celiac disease
EDDAEDKDED

SEQ ID NO: 1485 - protein, 10 aa, Homo sapiens
EDEEDEEDKE

SEQ ID NO: 1486 - protein, 10 aa, Homo sapiens
EDKDEDEEDE

SEQ ID NO: 1487 - protein, 10 aa, Homo sapiens
EDKEEDEEED

SEQ ID NO: 1488 - protein, 10 aa, Homo sapiens
EDKKRKEEEE

SEQ ID NO: 1489 - protein, 10 aa, unidentified
  REGION 1..10: note = epitope involved in celiac disease
EEAEDKEDDA

SEQ ID NO: 1490 - protein, 10 aa, Homo sapiens
EEDEEDKEED

SEQ ID NO: 1491 - protein, 10 aa, Homo sapiens
EEEDKKRKEE

SEQ ID NO: 1492 - protein, 10 aa, Homo sapiens
EEEEAEDKED

SEQ ID NO: 1493 - protein, 10 aa, Homo sapiens
EKDKGLQTSQ

SEQ ID NO: 1494 - protein, 10 aa, Homo sapiens
EKQMKDKQDE

SEQ ID NO: 1495 - protein, 10 aa, Homo sapiens
EQRLKEEEED

SEQ ID NO: 1496 - protein, 10 aa, unidentified
  REGION 1..10: note = epitope involved in celiac disease
FAEAPFSNKG

SEQ ID NO: 1497 - protein, 10 aa, Homo sapiens
GLQTSQDARF

SEQ ID NO: 1498 - protein, 10 aa, Homo sapiens
GVTKAAEKQM

SEQ ID NO: 1499 - protein, 10 aa, Homo sapiens
IFDNFLITND

SEQ ID NO: 1500 - protein, 10 aa, Homo sapiens
KDEDEEDEED

SEQ ID NO: 1501 - protein, 10 aa, Homo sapiens
KEEEEDKKRK

SEQ ID NO: 1502 - protein, 10 aa, Homo sapiens
KGKNVLINKD

SEQ ID NO: 1503 - protein, 10 aa, Homo sapiens
KIKDPDASKP

SEQ ID NO: 1504 - protein, 10 aa, Homo sapiens
KLFPNSLDQT

SEQ ID NO: 1505 - protein, 10 aa, Homo sapiens
KQDEEQRLKE

SEQ ID NO: 1506 - protein, 10 aa, Homo sapiens
KSGTIFDNFL

SEQ ID NO: 1507 - protein, 10 aa, Homo sapiens
LPPKKIKDPD

SEQ ID NO: 1508 - protein, 10 aa, Homo sapiens
QVKSGTIFDN

SEQ ID NO: 1509 - protein, 10 aa, Homo sapiens
RKEEEEAEDK

SEQ ID NO: 1510 - protein, 10 aa, Homo sapiens
RLKEEEEDKK

SEQ ID NO: 1511 - protein, 10 aa, Homo sapiens
TKAAEKQMKD

SEQ ID NO: 1512 - protein, 21 aa, Triticum aestivum
AHGRSQVLQQSTYQLLQELCC

SEQ ID NO: 1513 - protein, 21 aa, Triticum aestivum
AQGSVQPQQLPQFEEIRNLAL

SEQ ID NO: 1514 - protein, 21 aa, Triticum aestivum
FCMDVVLQQHNIAHGRSQVLQ

SEQ ID NO: 1515 - protein, 18 aa, Triticum aestivum
HNIAHGRSQVLQQSTYQL

SEQ ID NO: 1516 - protein, 21 aa, Triticum aestivum
LCCQHLWQIPEQSQCQAIHNV

SEQ ID NO: 1517 - protein, 15 aa, Triticum aestivum
LPYSQPQPFRPQQPY

SEQ ID NO: 1518 - protein, 21 aa, Triticum aestivum
LPYSQPQPFRPQQPYPQPQPQ

SEQ ID NO: 1519 - protein, 21 aa, Triticum aestivum
LQQHNIAHGRSQVLQQSTYQL

SEQ ID NO: 1520 - protein, 21 aa, Triticum aestivum
LQQQLIFCMDVVLQQHNIAHG

SEQ ID NO: 1521 - protein, 21 aa, Triticum aestivum
MKTFLILALLAIVATTATTAV

SEQ ID NO: 1522 - protein, 21 aa, Triticum aestivum
PLVQQQQFLGQQQPFPPQQPY

SEQ ID NO: 1523 - protein, 18 aa, Triticum aestivum
PPQQPYPQPQPFPSQQPY

SEQ ID NO: 1524 - protein, 21 aa, Triticum aestivum
PQQPISQQQQQQQQQQQQQQQ

SEQ ID NO: 1525 - protein, 21 aa, Triticum aestivum
QFLGQQQPFPPQQPYPQPQPF

SEQ ID NO: 1526 - protein, 21 aa, Triticum aestivum
QGSFRPSQQNPQAQGSVQPQQ

SEQ ID NO: 1527 - protein, 21 aa, Triticum aestivum
QNPSQQQPQEQVPLVQQQQFL

SEQ ID NO: 1528 - protein, 21 aa, Triticum aestivum
QPFPPQLPYSQPQPFRPQQPY

SEQ ID NO: 1529 - protein, 21 aa, Triticum aestivum
QPFPPQQPYPQPQPFPSQQPY

SEQ ID NO: 1530 - protein, 11 aa, Triticum aestivum
QPFPQPQLPYP

SEQ ID NO: 1531 - protein, 21 aa, Triticum aestivum
QPFPQPQLPYSQPQPFRPQQP

SEQ ID NO: 1532 - protein, 21 aa, Triticum aestivum
QPFPSQQPYLQLQPFPQPQLP

SEQ ID NO: 1533 - protein, 21 aa, Triticum aestivum
QPFRPQQPYPQPQPQYSQPQQ

SEQ ID NO: 1534 - protein, 21 aa, Triticum aestivum
QPQEQVPLVQQQQFLGQQQPF

SEQ ID NO: 1535 - protein, 21 aa, Triticum aestivum
QPQYSQPQQPISQQQQQQQQQ

SEQ ID NO: 1536 - protein, 21 aa, Triticum aestivum
QPSSQVSFQQPLQQYPLGQGS

SEQ ID NO: 1537 - protein, 21 aa, Triticum aestivum
QPYLQLQPFPQPQLPYSQPQP

SEQ ID NO: 1538 - protein, 21 aa, Triticum aestivum
QPYPQPQPFPSQQPYLQLQPF

SEQ ID NO: 1539 - protein, 21 aa, Triticum aestivum
QPYPQPQPQYSQPQQPISQQQ

SEQ ID NO: 1540 - protein, 21 aa, Triticum aestivum
QQKQQQQPSSQVSFQQPLQQY

SEQ ID NO: 1541 - protein, 18 aa, Triticum aestivum
QQQQFLGQQQPFPPQQPY

SEQ ID NO: 1542 - protein, 18 aa, Triticum aestivum
QQQQPSSQVSFQQPLQQY

SEQ ID NO: 1543 - protein, 21 aa, Triticum aestivum
QQQQQQQQQQQQQILQQILQQ

SEQ ID NO: 1544 - protein, 21 aa, Triticum aestivum
QQQQQQQQQQQQQQQQQQQIL

SEQ ID NO: 1545 - protein, 10 aa, Triticum aestivum
QQRPFIQPSL

SEQ ID NO: 1546 - protein, 21 aa, Triticum aestivum
QQYPLGQGSFRPSQQNPQAQG

SEQ ID NO: 1547 - protein, 21 aa, Triticum aestivum
SFQQPLQQYPLGQGSFRPSQQ

SEQ ID NO: 1548 - protein, 21 aa, Triticum aestivum
SQCQAIHNVVHAIILHQQQQQ

SEQ ID NO: 1549 - protein, 21 aa, Triticum aestivum
SQQNPQAQGSVQPQQLPQFEE

SEQ ID NO: 1550 - protein, 21 aa, Triticum aestivum
TAVRVPVPQLQPQNPSQQQPQ

SEQ ID NO: 1551 - protein, 21 aa, Triticum aestivum
VLQQSTYQLLQELCCQHLWQI

SEQ ID NO: 1552 - protein, 21 aa, Triticum aestivum
VPQLQPQNPSQQQPQEQVPLV

SEQ ID NO: 1553 - protein, 21 aa, Triticum aestivum
YQLLQELCCQHLWQIPEQSQC

SEQ ID NO: 1554 - protein, 12 aa, Triticum aestivum
AHGRSQVLQQST

SEQ ID NO: 1555 - protein, 12 aa, Triticum aestivum
ALQTLPAMCNVY

SEQ ID NO: 1556 - protein, 12 aa, Triticum aestivum
AMCNVYIPPYCT

SEQ ID NO: 1557 - protein, 12 aa, Triticum aestivum
EEIRNLALQTLP

SEQ ID NO: 1558 - protein, 12 aa, Triticum aestivum
FPPQQPYPQPQP

SEQ ID NO: 1559 - protein, 12 aa, Triticum aestivum
FPQPQLPYSQPQ

SEQ ID NO: 1560 - protein, 12 aa, Triticum aestivum
FPSQQPYLQLQP

SEQ ID NO: 1561 - protein, 12 aa, Triticum aestivum
FQQPLQQYPLGQ

SEQ ID NO: 1562 - protein, 12 aa, Triticum aestivum
GSFRPSQQNPQA

SEQ ID NO: 1563 - protein, 12 aa, Triticum aestivum
HNVVHAIILHQQ

SEQ ID NO: 1564 - protein, 12 aa, Triticum aestivum
IILHQQQKQQQQ

SEQ ID NO: 1565 - protein, 12 aa, Triticum aestivum
IPPYCTIAPFGI

SEQ ID NO: 1566 - protein, 12 aa, Triticum aestivum
LCCQHLWQIPEQ

SEQ ID NO: 1567 - protein, 12 aa, Triticum aestivum
LQQHNIAHGRSQ

SEQ ID NO: 1568 - protein, 12 aa, Triticum aestivum
LQQQLIPCMDVV

SEQ ID NO: 1569 - protein, 12 aa, Triticum aestivum
PCMDVVLQQHNI

SEQ ID NO: 1570 - protein, 12 aa, Triticum aestivum
PFRPQQPYPQPQ

SEQ ID NO: 1571 - protein, 12 aa, Triticum aestivum
PQYSQPQQPISQ

SEQ ID NO: 1572 - protein, 12 aa, Triticum aestivum
PSQQQPQEQVPL

SEQ ID NO: 1573 - protein, 12 aa, Triticum aestivum
PSSQVSFQQPLQ

SEQ ID NO: 1574 - protein, 12 aa, Triticum aestivum
PYSQPQPFRPQQ

SEQ ID NO: 1575 - protein, 12 aa, Triticum aestivum
QEQVPLVQQQQF

SEQ ID NO: 1576 - protein, 12 aa, Triticum aestivum
QGSVQPQQLPQF

SEQ ID NO: 1577 - protein, 12 aa, Triticum aestivum
QILQQILQQQLI

SEQ ID NO: 1578 - protein, 12 aa, Triticum aestivum
QKQQQQPSSQVS

SEQ ID NO: 1579 - protein, 12 aa, Triticum aestivum
QLQPQNPSQQQP

SEQ ID NO: 1580 - protein, 12 aa, Triticum aestivum
QQNPQAQGSVQP

SEQ ID NO: 1581 - protein, 12 aa, Triticum aestivum
QQPISQQILQQI

SEQ ID NO: 1582 - protein, 12 aa, Triticum aestivum
QYPLGQGSFRPS

SEQ ID NO: 1583 - protein, 12 aa, Triticum aestivum
SQCQAIHNVVHA

SEQ ID NO: 1584 - protein, 11 aa, Triticum aestivum
TIAPFGIFGTN

SEQ ID NO: 1585 - protein, 12 aa, Triticum aestivum
VLQQSTYQLLQE

SEQ ID NO: 1586 - protein, 12 aa, Triticum aestivum
VQQQQFLGQQQP

SEQ ID NO: 1587 - protein, 12 aa, Triticum aestivum
WQIPEQSQCQAI

SEQ ID NO: 1588 - protein, 12 aa, Triticum aestivum
YLQLQPFPQPQL

SEQ ID NO: 1589 - protein, 12 aa, Triticum aestivum
YPQPQPFPSQQP

SEQ ID NO: 1590 - protein, 12 aa, Triticum aestivum
YQLLQELCCQHL

SEQ ID NO: 1591 - protein, 15 aa, Triticum aestivum
QLQPFPQPQLPYPQP

SEQ ID NO: 1592 - protein, 12 aa, unidentified
  REGION 1..12: note = epitope involved in celiac disease
FPQQPEQPYPQQ

SEQ ID NO: 1593 - protein, 15 aa, Triticum aestivum
GQGIIQPQQPAQLIR

SEQ ID NO: 1594 - protein, 33 aa, Triticum aestivum; identical to SEQ ID NO: 1331

SEQ ID NO: 1595 - protein, 9 aa, Triticum aestivum
PFPQPQLPY

SEQ ID NO: 1596 - protein, 15 aa, Triticum aestivum
PFPQQPQQPYPQQPQ

SEQ ID NO: 1597 - protein, 25 aa, Triticum aestivum
PQLPQFLQPQPYPQPQLPYPQPQPF

SEQ ID NO: 1598 - protein, 9 aa, Triticum aestivum
PQPQLPQPQ

SEQ ID NO: 1599 - protein, 17 aa, Triticum aestivum
PQPQPFLPQLPYPQPQS

SEQ ID NO: 1600 - protein, 17 aa, Triticum aestivum
PQPQPFPPQLPYPQPQS

SEQ ID NO: 1601 - protein, 14 aa, Triticum aestivum
PQQPFPSQQQQPLI

SEQ ID NO: 1602 - protein, 15 aa, Triticum aestivum
PQQPQQSFPQQQQPA

SEQ ID NO: 1603 - protein, 14 aa, Triticum aestivum
PQQQTLQPQQPAQL

SEQ ID NO: 1604 - protein, 15 aa, Triticum aestivum
QIPQQQQIPQQPQQF

SEQ ID NO: 1605 - protein, 17 aa, Triticum aestivum
QLQPFPQPTLPYPQPQS

SEQ ID NO: 1606 - protein, 18 aa, Triticum aestivum
QPQPYPQPQLPYPQPQPF

SEQ ID NO: 1607 - protein, 17 aa, Triticum aestivum
QPQQPFPQPQQPFPWQP

SEQ ID NO: 1608 - protein, 15 aa, Triticum aestivum
QQFSQPQQQFPQPQQ

SEQ ID NO: 1609 - protein, 18 aa, unidentified
  REGION 1..18: note = epitope involved in celiac disease
QYPSGEGSFQPSQENPQA

SEQ ID NO: 1610 - protein, 6 aa, Triticum aestivum
QQQPFP

SEQ ID NO: 1611 - protein, 8 aa, Homo sapiens
ASFEPFSN

SEQ ID NO: 1612 - protein, 8 aa, Homo sapiens
FEPFSNKG

SEQ ID NO: 1613 - protein, 9 aa, Triticum aestivum
PQPQLPYPQ

SEQ ID NO: 1614 - protein, 9 aa, Triticum aestivum
QGSFQPSQQ

SEQ ID NO: 1615 - protein, 18 aa, Triticum aestivum
QPQQPFPQPQQPFPWQPQ

SEQ ID NO: 1616 - protein, 9 aa, Triticum aestivum
QQPQQPFPQ

SEQ ID NO: 1617 - protein, 9 aa, Triticum aestivum
QQPQQPYPQ

SEQ ID NO: 1618 - protein, 13 aa, Triticum aestivum
LGEGSFQPSQENP

SEQ ID NO: 1619 - protein, 15 aa, Triticum aestivum
LQPFPQPQLPYPQPQ

SEQ ID NO: 1620 - protein, 15 aa, Triticum aestivum
LQPFPQPQLPYSQPQ

SEQ ID NO: 1621 - protein, 16 aa, Triticum aestivum
QLQPFPHPQLPYPHPQ

SEQ ID NO: 1622 - protein, 16 aa, Triticum aestivum
QLQPFPHPQLPYPQPQ

SEQ ID NO: 1623 - protein, 16 aa, Triticum aestivum
QLQPFPQAQLPYSQPQ

SEQ ID NO: 1624 - protein, 16 aa, Triticum aestivum
QLQPFPQPQLPYPQPE

SEQ ID NO: 1625 - protein, 16 aa, Triticum aestivum
QLQPFPQPQLPYPQPQ

SEQ ID NO: 1626 - protein, 16 aa, Triticum aestivum
QLQPFPQPQLPYSQPE

SEQ ID NO: 1627 - protein, 16 aa, Triticum aestivum
QLQPFPQPQLPYSQPQ

SEQ ID NO: 1628 - protein, 14 aa, Aegilops tauschii
QLQPFPQPQLPYTH

SEQ ID NO: 1629 - protein, 16 aa, Triticum aestivum
QLQPFSQPQLPYSQPQ

SEQ ID NO: 1630 - protein, 17 aa, Triticum aestivum
QLQRPFPQPQLPYPQPE

SEQ ID NO: 1631 - protein, 15 aa, Triticum aestivum
QPFRPQQPYPQPQPQ

SEQ ID NO: 1632 - protein, 15 aa, Triticum aestivum
QPQPFLPQLPYPQPE

SEQ ID NO: 1633 - protein, 15 aa, Triticum aestivum
QPQPFQPQLPYPQPE

SEQ ID NO: 1634 - protein, 14 aa, Triticum aestivum
PQTQQPQQPFPQPQ

SEQ ID NO: 1635 - protein, 20 aa, Triticum aestivum
FEEIRNLALQTLPAMCNVYI

SEQ ID NO: 1636 - protein, 20 aa, Triticum aestivum
FLGQQQSFPPQQPYPQPQPF

SEQ ID NO: 1637 - protein, 17 aa, Triticum aestivum
PPYCTIVPFGIFGTNYR

SEQ ID NO: 1638 - protein, 20 aa, Triticum aestivum
QLIPCMDVVLQQHNIAHGRS

SEQ ID NO: 1639 - protein, 20 aa, Triticum aestivum
QVLQQSTYQLLQELCCQHLW

SEQ ID NO: 1640 - protein, 4 aa, Triticum aestivum
FFQP

SEQ ID NO: 1641 - protein, 8 aa, Triticum aestivum
IILHQQHH

SEQ ID NO: 1642 - protein, 4 aa, Triticum aestivum
IPEQ

SEQ ID NO: 1643 - protein, 8 aa, Triticum aestivum
PLVQEQQF

SEQ ID NO: 1644 - protein, 6 aa, Triticum aestivum
PQQLPQ

SEQ ID NO: 1645 - protein, 6 aa, Triticum aestivum
QGFFQP

SEQ ID NO: 1646 - protein, 6 aa, Triticum aestivum
QGSFQP

SEQ ID NO: 1647 - protein, 6 aa, Triticum aestivum
QLQPFP

SEQ ID NO: 1648 - protein, 6 aa, Triticum aestivum
QPQPFP

SEQ ID NO: 1649 - protein, 6 aa, Triticum aestivum
QPQQPF

SEQ ID NO: 1650 - protein, 8 aa, Triticum aestivum
QVPLVQEQ

SEQ ID NO: 1651 - protein, 6 aa, Triticum aestivum
WQIPEQ

SEQ ID NO: 1652 - protein, 11 aa, Triticum aestivum
PQPQLPYPQPQ

SEQ ID NO: 1653 - protein, 10 aa, Triticum aestivum
FPPQQPYPQP

SEQ ID NO: 1654 - protein, 10 aa, Triticum aestivum
LQQQQQQQQQ

SEQ ID NO: 1655 - protein, 10 aa, Triticum aestivum
PQQPYPQPQP

SEQ ID NO: 1656 - protein, 10 aa, Triticum aestivum
QKQQLQQQQQ

SEQ ID NO: 1657 - protein, 10 aa, Triticum aestivum
QLQPFPQPQP

SEQ ID NO: 1658 - protein, 10 aa, Triticum aestivum
QPFPQPQPFP

SEQ ID NO: 1659 - protein, 10 aa, Triticum aestivum
QPYLQLQPFP

SEQ ID NO: 1660 - protein, 10 aa, Triticum aestivum
QPYPQPQPFP

SEQ ID NO: 1661 - protein, 10 aa, Triticum aestivum
QQQQQILQQI

SEQ ID NO: 1662 - protein, 10 aa, Triticum aestivum
QQQQQQLQQQ

SEQ ID NO: 1663 - protein, 10 aa, Triticum aestivum
QQQQQQQILQ

SEQ ID NO: 1664 - protein, 10 aa, Triticum aestivum
QQQQQQQQLQ

SEQ ID NO: 1665 - protein, 10 aa, Triticum aestivum
QQQQQQQQQI

SEQ ID NO: 1666 - protein, 10 aa, Triticum aestivum
QVSFQQPQQQ

SEQ ID NO: 1667 - protein, 10 aa, Triticum aestivum
RDVVLQQHNI

SEQ ID NO: 1668 - protein, 10 aa, Triticum aestivum
RNLALQTLPA

SEQ ID NO: 1669 - protein, 10 aa, Triticum aestivum
SQQPYLQLQP

SEQ ID NO: 1670 - protein, 10 aa, Triticum aestivum
YLQLQPFPQP

SEQ ID NO: 1671 - protein, 10 aa, Triticum aestivum
CQQLWQIPEQ

SEQ ID NO: 1672 - protein, 10 aa, Triticum aestivum
FEEIRNLALQ

SEQ ID NO: 1673 - protein, 10 aa, Triticum aestivum
FLPQQPYPQP

SEQ ID NO: 1674 - protein, 10 aa, Triticum aestivum
FQPQQLPQFE

SEQ ID NO: 1675 - protein, 10 aa, Triticum aestivum
GSFQPQQLPQ

SEQ ID NO: 1676 - protein, 10 aa, Triticum aestivum
IAPFGIFGTN

SEQ ID NO: 1677 - protein, 10 aa, Triticum aestivum
LPYPQPQPFL

SEQ ID NO: 1678 - protein, 10 aa, Triticum aestivum
LSQVSFQQPQ

SEQ ID NO: 1679 - protein, 10 aa, Triticum aestivum
PLVQEQQFQG

SEQ ID NO: 1680 - protein, 10 aa, Triticum aestivum
PQFEEIRNLA

SEQ ID NO: 1681 - protein, 10 aa, Triticum aestivum
PQQLPQFEEI

SEQ ID NO: 1682 - protein, 10 aa, Triticum aestivum
PQQPISQQQQ

SEQ ID NO: 1683 - protein, 10 aa, Triticum aestivum
PQQQYPSGQG

SEQ ID NO: 1684 - protein, 10 aa, Triticum aestivum
QEQVPLVQEQ

SEQ ID NO: 1685 - protein, 10 aa, Triticum aestivum
QESTYQLVQQ

SEQ ID NO: 1686 - protein, 10 aa, Triticum aestivum
QGFFQPSQQN

SEQ ID NO: 1687 - protein, 10 aa, Triticum aestivum
QLPQFEEIRN

SEQ ID NO: 1688 - protein, 10 aa, Triticum aestivum
QLQLQNPSQQ

SEQ ID NO: 1689 - protein, 10 aa, Triticum aestivum
QLWQIPEQSR

SEQ ID NO: 1690 - protein, 10 aa, Triticum aestivum
QPFLPQQPYP

SEQ ID NO: 1691 - protein, 10 aa, Triticum aestivum
QPFPPQQPYP

SEQ ID NO: 1692 - protein, 10 aa, Triticum aestivum
QPISQQQQQQ

SEQ ID NO: 1693 - protein, 10 aa, Triticum aestivum
QPLSQVSFQQ

SEQ ID NO: 1694 - protein, 10 aa, Triticum aestivum
QPQPFLPQQP

SEQ ID NO: 1695 - protein, 10 aa, Triticum aestivum
QPQYSQPQQP

SEQ ID NO: 1696 - protein, 10 aa, Triticum aestivum
QQHHHHQEQK

SEQ ID NO: 1697 - protein, 10 aa, Triticum aestivum
QQPQQQYPSG

SEQ ID NO: 1698 - protein, 10 aa, Triticum aestivum
QQQPLSQVSF

SEQ ID NO: 1699 - protein, 10 aa, Triticum aestivum
QQQQQPLSQV

SEQ ID NO: 1700 - protein, 10 aa, Triticum aestivum
QQQQQQQPLS

SEQ ID NO: 1701 - protein, 10 aa, Triticum aestivum
QQYPSGQGFF

SEQ ID NO: 1702 - protein, 10 aa, Triticum aestivum
QVPLVQEQQF

SEQ ID NO: 1703 - protein, 10 aa, Triticum aestivum
QYSQPQQPIS

SEQ ID NO: 1704 - protein, 10 aa, Triticum aestivum
SGQGFFQPSQ

SEQ ID NO: 1705 - protein, 10 aa, Triticum aestivum
SQPQQPISQQ

SEQ ID NO: 1706 - protein, 10 aa, Triticum aestivum
STTIAPFGIF

SEQ ID NO: 1707 - protein, 10 aa, Triticum aestivum
TIAPFGIFGT

SEQ ID NO: 1708 - protein, 10 aa, Triticum aestivum
VLQESTYQLV

SEQ ID NO: 1709 - protein, 10 aa, Triticum aestivum
VPQLQLQNPS

SEQ ID NO: 1710 - protein, 10 aa, Triticum aestivum
VPVPQLQLQN

SEQ ID NO: 1711 - protein, 10 aa, Triticum aestivum
VRVPVPQLQL

SEQ ID NO: 1712 - protein, 10 aa, Triticum aestivum
WQIPEQSRCQ

SEQ ID NO: 1713 - protein, 10 aa, Triticum aestivum
YPQPQPFLPQ

SEQ ID NO: 1714 - protein, 10 aa, Triticum aestivum
YPSGQGFFQP

SEQ ID NO: 1715 - protein, 12 aa, Triticum aestivum
FPQPQQQFPQPQ

SEQ ID NO: 1716 - protein, 12 aa, Triticum aestivum
FPQQPQQPYPQQ

SEQ ID NO: 1717 - protein, 20 aa, Triticum aestivum
LQPQQPFPQQPQQPYPQQPQ

SEQ ID NO: 1718 - protein, 18 aa, Triticum aestivum
PHQPQQQVPQPQQPQQPF

SEQ ID NO: 1719 - protein, 14 aa, Triticum aestivum
PQQPQQSFPQQQRP

SEQ ID NO: 1720 - protein, 17 aa, Triticum aestivum
QPQQPFPQPQQPFPWQP

SEQ ID NO: 1721 - protein, 23 aa, Secale strictum
QQPFPQQPQQPYPQQPQQPFPQP

SEQ ID NO: 1722 - protein, 19 aa, Triticum aestivum
SHQQQPFPQQPYPQQPYPS

SEQ ID NO: 1723 - protein, 9 aa, Triticum aestivum
EGSFQPSQE

SEQ ID NO: 1724 - protein, 9 aa, Triticum aestivum
QGYYPTSPQ

SEQ ID NO: 1725 - protein, 687 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 1726 - protein, 15 aa, unidentified
  REGION 1..15: note = epitope involved in celiac disease
FPEQPQQPYPQQPQQ

SEQ ID NO: 1727 - protein, 14 aa, unidentified
  REGION 1..14: note = epitope involved in celiac disease
PQTEQPQQPFPQPQ

SEQ ID NO: 1728 - protein, 13 aa, unidentified
  REGION 1..13: note = epitope involved in celiac disease
QEGYYPTSPEQSG

SEQ ID NO: 1729 - protein, 13 aa, unidentified
  REGION 1..13: note = epitope involved in celiac disease
QEGYYPTSPQQSG

SEQ ID NO: 1730 - protein, 13 aa, unidentified
  REGION 1..13: note = epitope involved in celiac disease
QQGYYPTSPEQSG

SEQ ID NO: 1731 - protein, 14 aa, unidentified
  REGION 1..14: note = epitope involved in celiac disease
SGEGSFQPSQQNPQ

SEQ ID NO: 1732 - protein, 12 aa, unidentified
  REGION 1..12: note = epitope involved in celiac disease
QLQPFSQPQLPY

SEQ ID NO: 1733 - protein, 15 aa, unidentified
  REGION 1..15: note = epitope involved in celiac disease
QQPPFAEQEQPVLPQ

SEQ ID NO: 1734 - protein, 15 aa, unidentified
  REGION 1..15: note = epitope involved in celiac disease
QQPPFGEQEQPVLPQ

SEQ ID NO: 1735 - protein, 15 aa, Triticum aestivum
QQPPFSQQQQPVLPQ

SEQ ID NO: 1736 - protein, 15 aa, Triticum aestivum
QQPPFSQQQQQPLPQ

SEQ ID NO: 1737 - protein, 20 aa, Triticum aestivum
QQQQPPFSQQQQSPFSQQQQ

SEQ ID NO: 1738 - protein, 14 aa, unidentified
  REGION 1..14: note = epitope involved in celiac disease
AQPEQPEQPFPQPQ

SEQ ID NO: 1739 - protein, 14 aa, unidentified
  REGION 1..14: note = epitope involved in celiac disease
KQPEQPEQPFPQPQ

SEQ ID NO: 1740 - protein, 14 aa, unidentified
  REGION 1..14: note = epitope involved in celiac disease
PAPEQPEQPFPQPQ

SEQ ID NO: 1741 - protein, 14 aa, unidentified
  REGION 1..14: note = epitope involved in celiac disease
PKPEQPEQPFPQPQ

SEQ ID NO: 1742 - protein, 14 aa, unidentified
  REGION 1..14: note = epitope involved in celiac disease
PQAEQPEQPFPQPQ

SEQ ID NO: 1743 - protein, 14 aa, unidentified
  REGION 1..14: note = epitope involved in celiac disease
PQKEQPEQPFPQPQ

SEQ ID NO: 1744 - protein, 14 aa, unidentified
  REGION 1..14: note = epitope involved in celiac disease
PQPAQPEQPFPQPQ

SEQ ID NO: 1745 - protein, 14 aa, unidentified
  REGION 1..14: note = epitope involved in celiac disease
PQPEAPEQPFPQPQ

SEQ ID NO: 1746 - protein, 14 aa, unidentified
  REGION 1..14: note = epitope involved in celiac disease
PQPEQAEQPFPQPQ

SEQ ID NO: 1747 - protein, 14 aa, unidentified
  REGION 1..14: note = epitope involved in celiac disease
PQPEQPAQPFPQPQ

SEQ ID NO: 1748 - protein, 14 aa, unidentified
  REGION 1..14: note = epitope involved in celiac disease
PQPEQPEAPFPQPQ

SEQ ID NO: 1749 - protein, 14 aa, unidentified
  REGION 1..14: note = epitope involved in celiac disease
PQPEQPEQAFPQPQ

SEQ ID NO: 1750 - protein, 14 aa, unidentified
  REGION 1..14: note = epitope involved in celiac disease
PQPEQPEQPAPQPQ

SEQ ID NO: 1751 - protein, 14 aa, unidentified
  REGION 1..14: note = epitope involved in celiac disease
PQPEQPEQPFAQPQ

SEQ ID NO: 1752 - protein, 14 aa, unidentified
  REGION 1..14: note = epitope involved in celiac disease
PQPEQPEQPFPAPQ

SEQ ID NO: 1753 - protein, 14 aa, unidentified
  REGION 1..14: note = epitope involved in celiac disease
PQPEQPEQPFPKPQ

SEQ ID NO: 1754 - protein, 14 aa, unidentified
  REGION 1..14: note = epitope involved in celiac disease
PQPEQPEQPFPQAQ

SEQ ID NO: 1755 - protein, 14 aa, unidentified
  REGION 1..14: note = epitope involved in celiac disease
PQPEQPEQPFPQKQ

SEQ ID NO: 1756 - protein, 14 aa, unidentified
  REGION 1..14: note = epitope involved in celiac disease
PQPEQPEQPFPQPA

SEQ ID NO: 1757 - protein, 14 aa, unidentified
  REGION 1..14: note = epitope involved in celiac disease
PQPEQPEQPFPQPK

SEQ ID NO: 1758 - protein, 14 aa, unidentified
  REGION 1..14: note = epitope involved in celiac disease
PQPEQPEQPFPQPQ

SEQ ID NO: 1759 - protein, 14 aa, unidentified
  REGION 1..14: note = epitope involved in celiac disease
PQPEQPQQPFPQPQ

SEQ ID NO: 1760 - protein, 14 aa, unidentified
  REGION 1..14: note = epitope involved in celiac disease
PQPQQPEQPFPQPQ

SEQ ID NO: 1761 - protein, 17 aa, Triticum aestivum
QPQQPQQPFPQQQQPLI

SEQ ID NO: 1762 - protein, 17 aa, Triticum aestivum
QPQQPQQSFPQQQQLMI

SEQ ID NO: 1763 - protein, 17 aa, Triticum aestivum
QPQQPQQSFPQQQQPAI

SEQ ID NO: 1764 - protein, 17 aa, Triticum aestivum
QPQQPQQSFPQQQQPLI

SEQ ID NO: 1765 - protein, 18 aa, Triticum aestivum
QQYPSGQGSFQPSQQNPQ

SEQ ID NO: 1766 - protein, 13 aa, Triticum aestivum
SGQGSFQPSQQNP

SEQ ID NO: 1767 - protein, 15 aa, Homo sapiens
CDGERPTLAFLQDVM

SEQ ID NO: 1768 - protein, 9 aa, Influenza A virus
CTELKLSDY

SEQ ID NO: 1769 - protein, 10 aa, Homo sapiens
DGVAVLKVGG

SEQ ID NO: 1770 - protein, 17 aa, Human coxsackievirus
EAIPALTAVETGHTSQV

SEQ ID NO: 1771 - protein, 17 aa, Mycobacterium tuberculosis
EGDEATGANIVKVALEA

SEQ ID NO: 1772 - protein, 9 aa, Influenza A virus
ELRSRYWAI

SEQ ID NO: 1773 - protein, 15 aa, Homo sapiens
FVNQHLCGSHLVEAL

SEQ ID NO: 1774 - protein, 20 aa, Coxsackievirus B4
GAHETSLSASGNSIIHYTNI

SEQ ID NO: 1775 - protein, 10 aa, Homo sapiens
GCALLRCIPA

SEQ ID NO: 1776 - protein, 10 aa, Mycobacterium bovis
GGVAVIKAGA

SEQ ID NO: 1777 - protein, 9 aa, Influenza A virus
GILGFVFTL

SEQ ID NO: 1778 - protein, 20 aa, Coxsackievirus B4
GNSIIHYTNINYYKDAASNS

SEQ ID NO: 1779 - protein, 10 aa, Mycobacterium bovis
GVTLLQAAPT

SEQ ID NO: 1780 - protein, 13 aa, Homo sapiens
IAFTSEHSHFSLK

SEQ ID NO: 1781 - protein, 9 aa, Influenza A virus
ILRGSVAHK

SEQ ID NO: 1782 - protein, 10 aa, Mycobacterium bovis
IVAGGGVTLL

SEQ ID NO: 1783 - protein, 10 aa, Homo sapiens
IVLGGGCALL

SEQ ID NO: 1784 - protein, 9 aa, Influenza A virus
IYSTVASSL

SEQ ID NO: 1785 - protein, 9 aa, Lymphocytic choriomeningitis virus
KAVYNFATC

SEQ ID NO: 1786 - protein, 14 aa, Human poliovirus
KEVPALTAVETGAT

SEQ ID NO: 1787 - protein, 12 aa, Coxsackievirus B4
KILPEVKEKHEF

SEQ ID NO: 1788 - protein, 10 aa, Mycobacterium bovis
LAKLAGGVAV

SEQ ID NO: 1789 - protein, 10 aa, Homo sapiens
LAKLSDGVAV

SEQ ID NO: 1790 - protein, 20 aa, Mus musculus
LVLNRLKVGLQVVAVKAPGF

SEQ ID NO: 1791 - protein, 20 aa, Coxsackievirus B4
MGAQVSTQKTGAHETSLSAS

SEQ ID NO: 1792 - protein, 20 aa, Homo sapiens
NMYAMMIARFKMFPEVKEKG

SEQ ID NO: 1793 - protein, 30 aa, Coxsackievirus B4
NYYKDAASNSANRQDFTQDPSKFTEPVKDV

SEQ ID NO: 1794 - protein, 13 aa, Influenza A virus
PKYVKQNTLKLAT

SEQ ID NO: 1795 - protein, 15 aa, Mycobacterium sp.
PYILLVSSKVSTVKD

SEQ ID NO: 1796 - protein, 14 aa, Clostridium tetani
QYIKANSKFIGITE

SEQ ID NO: 1797 - protein, 11 aa, Influenza A virus
SFERFEIFPKE

SEQ ID NO: 1798 - protein, 15 aa, Mus musculus
SHLVEALYLVCGERG

SEQ ID NO: 1799 - protein, 8 aa, Gallus gallus
SIINFEKL

SEQ ID NO: 1800 - protein, 19 aa, Coxsackievirus B4
SKFTEPVKDVMIKSLPALN

SEQ ID NO: 1801 - protein, 15 aa, Mus musculus
TYEIAPVFVLLEYVT

SEQ ID NO: 1802 - protein, 24 aa, Mycobacterium bovis
VAGGGVTLLQAAPTLDELKLEGDE

SEQ ID NO: 1803 - protein, 24 aa, Homo sapiens
VLGGGVALLRVIPALDSLTPANED

SEQ ID NO: 1804 - protein, 20 aa, Rubella virus
AFGHSDAACWGFPTDTVMSV

SEQ ID NO: 1805 - protein, 20 aa, Homo sapiens
EIIKRTLKIPAMTIAKNAGV

SEQ ID NO: 1806 - protein, 20 aa, Homo sapiens
GEVIVTKDDAMLLKGKGDKA

SEQ ID NO: 1807 - protein, 20 aa, Homo sapiens
IVLGGGCALLRCIPALDSLT

SEQ ID NO: 1808 - protein, 20 aa, Homo sapiens
KFGADARALMLQGVDLLADA

SEQ ID NO: 1809 - protein, 20 aa, Homo sapiens
LVIIAEDVDGEALSTLVLNR

SEQ ID NO: 1810 - protein, 21 aa, Rubella virus
PTDVSCEGLGAWVPTAPCARI

SEQ ID NO: 1811 - protein, 9 aa, Homo sapiens
VMAPRTVLL

SEQ ID NO: 1812 - protein, 19 aa, Homo sapiens
PGSGFWSFGSEDGSGDSEN

SEQ ID NO: 1813 - protein, 9 aa, Homo sapiens
ALWMRLLPL

SEQ ID NO: 1814 - protein, 9 aa, Homo sapiens
FLFAVGFYL

SEQ ID NO: 1815 - protein, 9 aa, Homo sapiens
FLIVLSVAL

SEQ ID NO: 1816 - protein, 9 aa, Homo sapiens
FLWSVFMLI

SEQ ID NO: 1817 - protein, 26 aa, Homo sapiens
FWYIPPSLRTLEDNEERMSRLSKVAP

SEQ ID NO: 1818 - protein, 13 aa, Homo sapiens
GAHGDTTPEYQDL

SEQ ID NO: 1819 - protein, 10 aa, Homo sapiens
GIVEQCCTSI

SEQ ID NO: 1820 - protein, 9 aa, Homo sapiens
HLVEALYLV

SEQ ID NO: 1821 - protein, 34 aa, Homo sapiens
HTNVCFWYIPPSLRTLEDNEERMSRLSKVAPVIK

SEQ ID NO: 1822 - protein, 13 aa, Homo sapiens
KERLAALGPEGAH

SEQ ID NO: 1823 - protein, 23 aa, Homo sapiens
KERLAALGPEGAHGDTTPEYQDL

SEQ ID NO: 1824 - protein, 9 aa, Homo sapiens
KLQVFLIVL

SEQ ID NO: 1825 - protein, 9 aa, Homo sapiens
LLPPLLEHL

SEQ ID NO: 1826 - protein, 6 aa, Homo sapiens
MASPGS

SEQ ID NO: 1827 - protein, 20 aa, Homo sapiens
MASPGSGFWSFGSEDGSGDS

SEQ ID NO: 1828 - protein, 13 aa, Homo sapiens
NFFRMVISNPAAT

SEQ ID NO: 1829 - protein, 13 aa, unidentified
  REGION 1..13: note = epitope involved in diabetes
NFIRMVISNPAAT

SEQ ID NO: 1830 - protein, 13 aa, unidentified
  REGION 1..13: note = epitope involved in diabetes
QPLALEGSLQSRG

SEQ ID NO: 1831 - protein, 9 aa, Homo sapiens
RLLCALTSL

SEQ ID NO: 1832 - protein, 15 aa, Homo sapiens
RTLEDNEERMSRLSK

SEQ ID NO: 1833 - protein, 9 aa, Homo sapiens
SLAAGVKLL

SEQ ID NO: 1834 - protein, 10 aa, Homo sapiens
SLQKRGIVEQ

SEQ ID NO: 1835 - protein, 9 aa, Homo sapiens
SLQPLALEG

SEQ ID NO: 1836 - protein, 15 aa, Homo sapiens
SLQPLALEGSLQKRG

SEQ ID NO: 1837 - protein, 15 aa, unidentified
  REGION 1..15: note = epitope involved in diabetes
SLQPLALEGSLQSRG

SEQ ID NO: 1838 - protein, 9 aa, Homo sapiens
SLSPLQAEL

SEQ ID NO: 1839 - protein, 9 aa, Homo sapiens
SLYQLENYC

SEQ ID NO: 1840 - skipped

SEQ ID NO: 1841 - protein, 585 aa, Homo sapiens
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 1842 - protein, 14 aa, Homo sapiens
AFIEFKADEKKEDE

SEQ ID NO: 1843 - protein, 15 aa, Homo sapiens
CFWYIPPSLRTLEDN

SEQ ID NO: 1844 - protein, 15 aa, Homo sapiens
ERMSRLSKVAPVIKA

SEQ ID NO: 1845 - protein, 18 aa, Bos taurus
FKADEKKFWGKYLYEIAR

SEQ ID NO: 1846 - protein, 33 aa, Homo sapiens
NMYAMMIARFKMFPEVKEKGMAALPRLIAFTSE

SEQ ID NO: 1847 - protein, 20 aa, Homo sapiens
SRLSKVAPVIKARMMEYGTT

SEQ ID NO: 1848 - protein, 41 aa, Homo sapiens
VSYQPLGDKVNFFRMVISNPAATHQDIDFLIEEIERLGQDL

SEQ ID NO: 1849 - protein, 20 aa, Homo sapiens
AEDEVQRERVSAKNALESYA

SEQ ID NO: 1850 - protein, 20 aa, Homo sapiens
AEKDEFEHKRKELEQVCNPI

SEQ ID NO: 1851 - protein, 20 aa, Homo sapiens
AGGVMTALIKRNSTIPTKQT

SEQ ID NO: 1852 - protein, 10 aa, Homo sapiens
AKSKNHTTHN

SEQ ID NO: 1853 - protein, 9 aa, Homo sapiens
ALTAVAEEV

SEQ ID NO: 1854 - protein, 12 aa, Homo sapiens
AQVATISANGDK

SEQ ID NO: 1855 - protein, 12 aa, Homo sapiens
AVADICKKYKIW

SEQ ID NO: 1856 - protein, 20 aa, Homo sapiens
DGVTVAKSIDLKDKYKNIGA

SEQ ID NO: 1857 - protein, 31 aa, Homo sapiens
DKVNFFRMVISNPAATHQDIDFLIEEIERLG

SEQ ID NO: 1858 - protein, 20 aa, Homo sapiens
DTERLIGDAAKNQVALNPQN

SEQ ID NO: 1859 - protein, 16 aa, Homo sapiens
EDLQVGQVELGGGPGA

SEQ ID NO: 1860 - protein, 20 aa, Mus musculus
EEIAQVATISANGDKDIGNI

SEQ ID NO: 1861 - protein, 20 aa, Homo sapiens
EEIAQVATISANGDKEIGNI

SEQ ID NO: 1862 - protein, 9 aa, Homo sapiens
FLQDVMNIL

SEQ ID NO: 1863 - protein, 16 aa, Homo sapiens
FYTPKTRREAEDLQVG

SEQ ID NO: 1864 - protein, 18 aa, Homo sapiens
GAGSLQPLALEGSLQKRG

SEQ ID NO: 1865 - protein, 20 aa, Homo sapiens
GLNVLRIINEPTAAAIAYGL

SEQ ID NO: 1866 - protein, 10 aa, Homo sapiens
GSGPTIEEVD

SEQ ID NO: 1867 - protein, 10 aa, Homo sapiens
HLCGSHLVEA

SEQ ID NO: 1868 - protein, 16 aa, Homo sapiens
HLVEALYLVCGERGFF

SEQ ID NO: 1869 - protein, 20 aa, Homo sapiens
IAYGLDRTGKGERNVLIFDL

SEQ ID NO: 1870 - protein, 15 aa, Homo sapiens
IDFLIEEIERLGQDL

SEQ ID NO: 1871 - protein, 20 aa, Homo sapiens
IPPSLRTLEDNEERMSRLSK

SEQ ID NO: 1872 - protein, 20 aa, Homo sapiens
KANKITITNDKGRLSKEEIE

SEQ ID NO: 1873 - protein, 20 aa, Homo sapiens
KAPGFGDNRKNQLKDMAIAT

SEQ ID NO: 1874 - protein, 20 aa, Homo sapiens
KEEIERMVQEAEKYKAEDEV

SEQ ID NO: 1875 - protein, 15 aa, Homo sapiens
KKGAAALGIGTDSVI

SEQ ID NO: 1876 - protein, 12 aa, Homo sapiens
KKYKIWMHVDAA

SEQ ID NO: 1877 - protein, 12 aa, Homo sapiens
KLCALLYGDAEK

SEQ ID NO: 1878 - protein, 20 aa, Homo sapiens
KRTLSSSTQASLEIDSLFEG

SEQ ID NO: 1879 - protein, 18 aa, Homo sapiens
KVNFFRMVISNPAATHQD

SEQ ID NO: 1880 - protein, 20 aa, Homo sapiens
LESYAFNMKSAVEDEGLKGK

SEQ ID NO: 1881 - protein, 15 aa, Homo sapiens
LKKMREIIGWPGGSG

SEQ ID NO: 1882 - protein, 20 aa, Homo sapiens
LLADAVAVTMGPKGRTVIIE

SEQ ID NO: 1883 - protein, 20 aa, Homo sapiens
LLLLDVAPLSLGLETAGGVM

SEQ ID NO: 1884 - protein, 9 aa, Homo sapiens
LLQEYNWEL

SEQ ID NO: 1885 - protein, 9 aa, Mus musculus
LYLVCGERG

SEQ ID NO: 1886 - protein, 20 aa, Homo sapiens
MAKAAAVGIDLGTTYSCVGV

SEQ ID NO: 1887 - protein, 12 aa, Homo sapiens
MASPGSGFWSFG

SEQ ID NO: 1888 - protein, 20 aa, Homo sapiens
MLRLPTVFRQMRPVSRVLAP

SEQ ID NO: 1889 - protein, 20 aa, Homo sapiens
NDQGNRTTPSYVAFTDTERL

SEQ ID NO: 1890 - protein, 20 aa, Homo sapiens
NEEAGDGTTTATVLARSIAK

SEQ ID NO: 1891 - protein, 14 aa, Homo sapiens
NILLQYVVKSFDRS

SEQ ID NO: 1892 - protein, 13 aa, Homo sapiens
NPAATHQDIDFLI

SEQ ID NO: 1893 - protein, 20 aa, Homo sapiens
NPVEIRRGVMLAVDAVIAEL

SEQ ID NO: 1894 - protein, 12 aa, Homo sapiens
PAESGGSQPPRA

SEQ ID NO: 1895 - protein, 20 aa, Homo sapiens
PAPGVPQIEVTFDIDANGIL

SEQ ID NO: 1896 - protein, 20 aa, Homo sapiens
PFQVINDGDKPKVQVSYKGE

SEQ ID NO: 1897 - protein, 20 aa, Homo sapiens
PGPGGFGAQGPKGGSGSGPT

SEQ ID NO: 1898 - protein, 20 aa, Homo sapiens
PTKQTQIFTTYSDNQPGVLI

SEQ ID NO: 1899 - protein, 13 aa, unidentified
  REGION 1..13: note = epitope involved in diabetes
PVQLSNQWHVVGA

SEQ ID NO: 1900 - protein, 20 aa, Homo sapiens
QDAYVLLSEKKISSIQSIVP

SEQ ID NO: 1901 - protein, 21 aa, Homo sapiens
QSIVPALEIANAHRKPLVIIA

SEQ ID NO: 1902 - protein, 20 aa, Homo sapiens
RFEELCSDLFRSTLEPVEKA

SEQ ID NO: 1903 - protein, 20 aa, Homo sapiens
RKGVITVKDGKTLNDELEII

SEQ ID NO: 1904 - protein, 10 aa, Homo sapiens
RMMEYGTTMV

SEQ ID NO: 1905 - protein, 20 aa, Homo sapiens
RSIAKEGFEKISKGANPVEI

SEQ ID NO: 1906 - protein, 20 aa, Homo sapiens
RVLAPHLTRAYAKDVKFGAD

SEQ ID NO: 1907 - protein, 20 aa, Homo sapiens
SCVGVFQHGKVEIIANDQGN

SEQ ID NO: 1908 - protein, 10 aa, Homo sapiens
SLYHVYEVNL

SEQ ID NO: 1909 - protein, 12 aa, Homo sapiens
TARAWCQVAQKF

SEQ ID NO: 1910 - protein, 20 aa, Homo sapiens
THLGGEDFDNRLVNHFVEEF

SEQ ID NO: 1911 - protein, 9 aa, Homo sapiens
TIADFWQMV

SEQ ID NO: 1912 - protein, 20 aa, Homo sapiens
TIDDGIFEVKATAGDTHLGG

SEQ ID NO: 1913 - protein, 20 aa, Homo sapiens
TVIIEQSWGSPKVTKDGVTV

SEQ ID NO: 1914 - protein, 10 aa, Homo sapiens
VCGERGFFYT

SEQ ID NO: 1915 - protein, 20 aa, Homo sapiens
VCNPIISGLYQGAGGPGPGG

SEQ ID NO: 1916 - protein, 20 aa, Homo sapiens
VDKCLELAEYLYNIIKNREG

SEQ ID NO: 1917 - protein, 13 aa, Homo sapiens
VEQCCTSICSLYQ

SEQ ID NO: 1918 - protein, 20 aa, Homo sapiens
VIAELKKQSKPVTTPEEIAQ

SEQ ID NO: 1919 - protein, 9 aa, Homo sapiens
VIVMLTPLV

SEQ ID NO: 1920 - protein, 24 aa, unidentified
  REGION 1..24: note = epitope involved in diabetes
VLGGGVLLLRVIPALDSLTPANED

SEQ ID NO: 1921 - protein, 10 aa, Homo sapiens
VMNILLQYVV

SEQ ID NO: 1922 - protein, 20 aa, Homo sapiens
VNMVEKGIIDPTKVVRTALL

SEQ ID NO: 1923 - protein, 20 aa, Homo sapiens
VQKLLQDFFNGRDLNKSINP

SEQ ID NO: 1924 - protein, 20 aa, Homo sapiens
VTDALNATRAAVEEGIVLGG

SEQ ID NO: 1925 - protein, 9 aa, Mus musculus
VYLKTNVFL

SEQ ID NO: 1926 - protein, 13 aa, Homo sapiens
AKGTTGFEAHVDK

SEQ ID NO: 1927 - protein, 10 aa, Homo sapiens
ALWGPDPAAA

SEQ ID NO: 1928 - protein, 15 aa, Homo sapiens
FDRSTKVIDFHYPNE

SEQ ID NO: 1929 - protein, 20 aa, Homo sapiens
FFRMVISNPAATHQDIDFLI

SEQ ID NO: 1930 - protein, 13 aa, Homo sapiens
FFYTPKTRREAED

SEQ ID NO: 1931 - protein, 17 aa, Homo sapiens
FYTPKTRREAEDLQVGQ

SEQ ID NO: 1932 - protein, 17 aa, Homo sapiens
GGPGAGSLQPLALEGSL

SEQ ID NO: 1933 - protein, 12 aa, Homo sapiens
GHPRYFNQLSTG

SEQ ID NO: 1934 - protein, 20 aa, Homo sapiens
IPPSLRYLEDNEERMSRLSK

SEQ ID NO: 1935 - protein, 20 aa, Mus musculus
KGDKAHIEKRIQEITEQLDI

SEQ ID NO: 1936 - protein, 15 aa, Homo sapiens
KHYDLSYDTGDKALQ

SEQ ID NO: 1937 - protein, 15 aa, Homo sapiens
KRGIVEQCCTSICSL

SEQ ID NO: 1938 - protein, 9 aa, Homo sapiens
LALEGSLQK

SEQ ID NO: 1939 - protein, 17 aa, Homo sapiens
LALWGPDPAAAFVNQHL

SEQ ID NO: 1940 - protein, 17 aa, Homo sapiens
LLPLLALLALWGPDPAA

SEQ ID NO: 1941 - protein, 9 aa, Homo sapiens
LNIDLLWSV

SEQ ID NO: 1942 - protein, 14 aa, Homo sapiens
LPRLIAFTSEHSHF

SEQ ID NO: 1943 - protein, 15 aa, Homo sapiens
LPRLIAFTSEHSHFS

SEQ ID NO: 1944 - protein, 17 aa, Homo sapiens
LVEALYLVCGERGFFYT

SEQ ID NO: 1945 - protein, 10 aa, unidentified
  REGION 1..10: note = epitope involved in diabetes
LWEIEFAKQL

SEQ ID NO: 1946 - protein, 16 aa, Homo sapiens
MALWMRLLPLLALLAL

SEQ ID NO: 1947 - protein, 20 aa, Homo sapiens
NWELADQPQNLEEILMHCQT

SEQ ID NO: 1948 - protein, 17 aa, Homo sapiens
PAAAFVNQHLCGSHLVE

SEQ ID NO: 1949 - protein, 14 aa, Homo sapiens
PGSGFWSFGSEDGS

SEQ ID NO: 1950 - protein, 17 aa, Homo sapiens
QHLCGSHLVEALYLVCG

SEQ ID NO: 1951 - protein, 17 aa, Homo sapiens
REAEDLQVGQVELGGGP

SEQ ID NO: 1952 - protein, 12 aa, Homo sapiens
RLIAFTSEHSHF

SEQ ID NO: 1953 - protein, 9 aa, Homo sapiens
RLLPLLALL

SEQ ID NO: 1954 - protein, 15 aa, Homo sapiens
RMMEYGTTMVSYQPL

SEQ ID NO: 1955 - protein, 20 aa, Mus musculus
RTALLDAAGVASLLTTAEAV

SEQ ID NO: 1956 - protein, 20 aa, Mus musculus
TAEAVVTEIPKEEKDPGMGA

SEQ ID NO: 1957 - protein, 20 aa, Homo sapiens [sequence omitted]

SEQ ID NO: 1958 - protein, 17 aa, Homo sapiens
VCGERGFFYTPKTRREA

SEQ ID NO: 1959 - protein, 17 aa, Homo sapiens
VGQVELGGGPGAGSLQP

SEQ ID NO: 1960 - protein, 9 aa, Homo sapiens
VLFGLGFAI

SEQ ID NO: 1961 - protein, 24 aa, Homo sapiens
VLGGGCALLRCIPALDSLTPANED

SEQ ID NO: 1962 - protein, 8 aa, Homo sapiens
WGPDPAAA

SEQ ID NO: 1963 - protein, 582 aa, Homo sapiens
PGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 1964 - protein, 11 aa, Homo sapiens
AFTSEHSHFSL

SEQ ID NO: 1965 - protein, 12 aa, Homo sapiens
AFTSEHSHFSLK

SEQ ID NO: 1966 - protein, 17 aa, Homo sapiens
AGSLQPLALEGSLQKRG

SEQ ID NO: 1967 - protein, 9 aa, Homo sapiens
ALYLVCGER

SEQ ID NO: 1968 - protein, 18 aa, Homo sapiens
ANTNMFTYEIAPVFVLLE

SEQ ID NO: 1969 - protein, 20 aa, Homo sapiens
ATHQDIDFLIEEIERLGQDL

SEQ ID NO: 1970 - protein, 9 aa, unidentified
  REGION 1..9: note = epitope involved in diabetes
AYNKANWFL

SEQ ID NO: 1971 - protein, 16 aa, Homo sapiens
CCTSICSLYQLENYCN

SEQ ID NO: 1972 - protein, 11 aa, unidentified
  REGION 1..11: note = epitope involved in diabetes
CHAVKVGNPSC

SEQ ID NO: 1973 - protein, 11 aa, unidentified
  REGION 1..11: note = epitope involved in diabetes
CPRDLNGKSGC

SEQ ID NO: 1974 - protein, 20 aa, Homo sapiens
EAKQKGFVPFLVSATAGTTV

SEQ ID NO: 1975 - protein, 20 aa, Homo sapiens
ERMSRLSKVAPVIKARMMEY

SEQ ID NO: 1976 - protein, 20 aa, Homo sapiens
EVKEKGMAALPRLIAFTSEH

SEQ ID NO: 1977 - protein, 11 aa, Homo sapiens
FKMFPEVKEKG

SEQ ID NO: 1978 - protein, 10 aa, Homo sapiens
FTSEHSHFSL

SEQ ID NO: 1979 - protein, 17 aa, Homo sapiens
FVNQHLCGSHLVEALYL

SEQ ID NO: 1980 - protein, 13 aa, Homo sapiens
FWYIPPSLRTLED

SEQ ID NO: 1981 - protein, 20 aa, Homo sapiens
GDKVNFFRMVISNPAATHQD

SEQ ID NO: 1982 - protein, 17 aa, Homo sapiens
GERGFFYTPKTRREAED

SEQ ID NO: 1983 - protein, 21 aa, Homo sapiens
GGGLLMSRKHKWKLSGVERAN

SEQ ID NO: 1984 - protein, 15 aa, Homo sapiens
GIVEQCCTSICSLYQ

SEQ ID NO: 1985 - protein, 19 aa, Homo sapiens
GLMQNCNQMHASYLFQQDK

SEQ ID NO: 1986 - protein, 17 aa, Homo sapiens
GQVELGGGPGAGSLQPL

SEQ ID NO: 1987 - protein, 15 aa, Homo sapiens
GSHLVEALYLVCGER

SEQ ID NO: 1988 - protein, 17 aa, Homo sapiens
GSLQKRGIVEQCCTSIC

SEQ ID NO: 1989 - protein, 20 aa, Homo sapiens
GTTMVSYQPLGDKVNFFRMV

SEQ ID NO: 1990 - protein, 15 aa, Homo sapiens
HLCGSHLVEALYLVC

SEQ ID NO: 1991 - protein, 15 aa, Homo sapiens
HLVEALYLVCGERGF

SEQ ID NO: 1992 - protein, 20 aa, Homo sapiens
HTNVCFWYIPPSLRTLEDNE

SEQ ID NO: 1993 - protein, 14 aa, unidentified
  REGION 1..14: note = epitope involved in diabetes
IMEQCFEIGCPATN

SEQ ID NO: 1994 - protein, 16 aa, Homo sapiens
IPPSLRTLEDNEERMS

SEQ ID NO: 1995 - protein, 20 aa, Homo sapiens
ISNPAATHQDIDFLIEEIER

SEQ ID NO: 1996 - protein, 9 aa, unidentified
  REGION 1..9: note = epitope involved in diabetes
KYNKAAWFL

SEQ ID NO: 1997 - protein, 9 aa, unidentified
  REGION 1..9: note = epitope involved in diabetes
KYNKANAFL

SEQ ID NO: 1998 - protein, 9 aa, unidentified
  REGION 1..9: note = epitope involved in diabetes
KYNKANWAL

SEQ ID NO: 1999 - protein, 9 aa, unidentified
  REGION 1..9: note = epitope involved in diabetes
KYNKANWFL

SEQ ID NO: 2000 - protein, 17 aa, Homo sapiens
LCGSHLVEALYLVCGER

SEQ ID NO: 2001 - protein, 14 aa, unidentified
  REGION 1..14: note = epitope involved in diabetes
LMEPCYAWGCTGPK

SEQ ID NO: 2002 - protein, 15 aa, Homo sapiens
LVEALYLVCGERGFF

SEQ ID NO: 2003 - protein, 15 aa, Homo sapiens
LYLVCGERGFFYTPK

SEQ ID NO: 2004 - protein, 15 aa, Homo sapiens
MIARFKMFPEVKEKG

SEQ ID NO: 2005 - protein, 20 aa, Homo sapiens
MMIARFKMFPEVKEKGMAAL

SEQ ID NO: 2006 - protein, 10 aa, Homo sapiens
MYAMMIARFK

SEQ ID NO: 2007 - protein, 12 aa, Homo sapiens
MYAMMIARFKMF

SEQ ID NO: 2008 - protein, 14 aa, unidentified
  REGION 1..14: note = epitope involved in diabetes
NDSQCWKLGCIAEK

SEQ ID NO: 2009 - protein, 12 aa, Homo sapiens
NILLQYVVKSFD

SEQ ID NO: 2010 - protein, 14 aa, unidentified
  REGION 1..14: note = epitope involved in diabetes
NPEDCFKTGCNSPT

SEQ ID NO: 2011 - protein, 12 aa, Homo sapiens
NYAFLHATDLLP

SEQ ID NO: 2012 - protein, 20 aa, Homo sapiens
PSLRTLEDNEERMSRLSKVA

SEQ ID NO: 2013 - protein, 20 aa, Homo sapiens
PVIKARMMEYGTTMVSYQPL

SEQ ID NO: 2014 - protein, 15 aa, Homo sapiens
QHLCGSHLVEALYLV

SEQ ID NO: 2015 - protein, 9 aa, Homo sapiens
RFKMFPEVK

SEQ ID NO: 2016 - protein, 10 aa, Homo sapiens
RFKMFPEVKE

SEQ ID NO: 2017 - protein, 11 aa, Homo sapiens
RFKMFPEVKEK

SEQ ID NO: 2018 - protein, 10 aa, Homo sapiens
SHLVEALYLV

SEQ ID NO: 2019 - protein, 14 aa, unidentified
  REGION 1..14: note = epitope involved in diabetes
SNVECDGLNCDWII

SEQ ID NO: 2020 - protein, 16 aa, Homo sapiens
SPSLWEIEFAKQLASV

SEQ ID NO: 2021 - protein, 16 aa, unidentified
  REGION 1..16: note = epitope involved in diabetes
SPSLWEIEIAKQLASV

SEQ ID NO: 2022 - protein, 17 aa, Homo sapiens
TRREAEDLQVGQVELGG

SEQ ID NO: 2023 - protein, 9 aa, Homo sapiens
TSEHSHFSL

SEQ ID NO: 2024 - protein, 15 aa, Homo sapiens
VEALYLVCGERGFFY

SEQ ID NO: 2025 - protein, 9 aa, Homo sapiens
VMNILLQYV

SEQ ID NO: 2026 - protein, 20 aa, Homo sapiens
YEMVFDGKPQHTNVCFWYIP

SEQ ID NO: 2027 - protein, 15 aa, Homo sapiens
YLVCGERGFFYTPKT

SEQ ID NO: 2028 - protein, 979 aa, Homo sapiens
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 2029 - protein, 20 aa, Homo sapiens
AALGIGTDSVILIKCDERGK

SEQ ID NO: 2030 - protein, 12 aa, Homo sapiens
AFIKATGKKEDE

SEQ ID NO: 2031 - protein, 11 aa, Mus musculus
APVIKARMMEY

SEQ ID NO: 2032 - protein, 13 aa, Homo sapiens
CAYQAEPNTCATA

SEQ ID NO: 2033 - protein, 13 aa, Homo sapiens
CTVIVMLTPLVED

SEQ ID NO: 2034 - protein, 13 aa, Homo sapiens
DQFEFALTAVAEE

SEQ ID NO: 2035 - protein, 15 aa, unidentified
  REGION 1..15: note = epitope involved in diabetes
EKAHRPIWARMDAKK

SEQ ID NO: 2036 - protein, 20 aa, Homo sapiens
EYVTLKKMREIIGWPGGSGD

SEQ ID NO: 2037 - protein, 15 aa, Bos taurus
FKADEKKFWGKYLYE

SEQ ID NO: 2038 - protein, 19 aa, Homo sapiens
FYLKNVQTQETRTLTQFHF

SEQ ID NO: 2039 - protein, 20 aa, Homo sapiens
GMAALPRLIAFTSEHSHFSL

SEQ ID NO: 2040 - protein, 13 aa, Homo sapiens
GSFINISVVGPAL

SEQ ID NO: 2041 - protein, 18 aa, Homo sapiens
GSLQPLALEGSLQKRGIV

SEQ ID NO: 2042 - protein, 20 aa, Mus musculus
HTPGVHMASLSVYLKTNVFL

SEQ ID NO: 2043 - protein, 15 aa, Homo sapiens
IKARMMEYGTTMVSY

SEQ ID NO: 2044 - protein, 20 aa, Homo sapiens
IKLKVESSPSRSDYINASPI

SEQ ID NO: 2045 - protein, 9 aa, unidentified
  REGION 1..9: note = epitope involved in diabetes
KYNKANVFL

SEQ ID NO: 2046 - protein, 23 aa, Homo sapiens
LAKEWQALCAYQAEPNTCATAQG

SEQ ID NO: 2047 - protein, 15 aa, Homo sapiens
LAKLSDGVAVLKVGG

SEQ ID NO: 2048 - protein, 13 aa, Homo sapiens
LEILAEHVHMSSG

SEQ ID NO: 2049 - protein, 19 aa, Mus musculus
LHRSGVLIIHHLQEDYRTY

SEQ ID NO: 2050 - protein, 20 aa, Homo sapiens
LYHVYEVNLVSEHIWCEDFL

SEQ ID NO: 2051 - protein, 17 aa, Homo sapiens
MASPGSGFWSFGSEDGS

SEQ ID NO: 2052 - protein, 37 aa, Homo sapiens
MGILKLQVFLIVLSVALNHLKATPIESHQVEKRKCNT

SEQ ID NO: 2053 - protein, 15 aa, Homo sapiens
MVFDGKPQHTNVCFW

SEQ ID NO: 2054 - protein, 21 aa, Homo sapiens
MVWESGCTVIVMLTPLVEDGV

SEQ ID NO: 2055 - protein, 9 aa, unidentified
  REGION 1..9: note = epitope involved in diabetes
NRVAPNVRQ

SEQ ID NO: 2056 - protein, 13 aa, Homo sapiens
PAYIATQGPLSHT

SEQ ID NO: 2057 - protein, 15 aa, Mus musculus
PHLVEALYLVCGERG

SEQ ID NO: 2058 - protein, 13 aa, Homo sapiens
PSLSYEPALLQPY

SEQ ID NO: 2059 - protein, 15 aa, Mus musculus
PVIKARMMEYGTTMV

SEQ ID NO: 2060 - protein, 13 aa, Homo sapiens
RSVLLTLVALAGV

SEQ ID NO: 2061 - protein, 20 aa, Homo sapiens
SEHIWCEDFLVRSFYLKNVQ

SEQ ID NO: 2062 - protein, 15 aa, Mus musculus
SHLVEALYLVAGERG

SEQ ID NO: 2063 - protein, 21 aa, Homo sapiens
SKDQFEFALTAVAEEVNAILK

SEQ ID NO: 2064 - protein, 13 aa, Homo sapiens
SLYHVYEVNLVSE

SEQ ID NO: 2065 - protein, 10 aa, Mus musculus
SLYQLENYCN

SEQ ID NO: 2066 - protein, 18 aa, Mus musculus
TAALSYTISRMEESSVTL

SEQ ID NO: 2067 - protein, 15 aa, Homo sapiens
TGHPRYFNQLSTGLD

SEQ ID NO: 2068 - protein, 13 aa, Mus musculus
TQYEAVATSNMQE

SEQ ID NO: 2069 - protein, 13 aa, Homo sapiens
TYILIDMVLNRMA

SEQ ID NO: 2070 - protein, 16 aa, Mus musculus
VPPSLRTLEDNEERMS

SEQ ID NO: 2071 - protein, 16 aa, Mus musculus
VPTSLRRLEQPNVAIS

SEQ ID NO: 2072 - protein, 18 aa, Homo sapiens
VSSQFSDAAQASPSSHSS

SEQ ID NO: 2073 - protein, 23 aa, Mus musculus
WYVMVTAALSYTISRMEESSVTL

SEQ ID NO: 2074 - protein, 979 aa, Homo sapiens; identical to SEQ ID NO: 2028

SEQ ID NO: 2075 - protein, 11 aa, unidentified
  REGION 1..11: note = epitope involved in diabetes
AVRPLWVRMEA

SEQ ID NO: 2076 - protein, 10 aa, Homo sapiens
DTTFEYQDLC

SEQ ID NO: 2077 - protein, 11 aa, Mus musculus
EALYLVCGERG

SEQ ID NO: 2078 - protein, 9 aa, Homo sapiens
ELAEYLYNI

SEQ ID NO: 2079 - protein, 10 aa, Homo sapiens
GAHGDTTFEY

SEQ ID NO: 2080 - protein, 7 aa, unidentified
  REGION 1..7: note = epitope involved in diabetes
GERAKRS

SEQ ID NO: 2081 - protein, 12 aa, Bos taurus
GIVEQCCASVCS

SEQ ID NO: 2082 - protein, 15 aa, Bos taurus
GIVEQCCASVCSLYQ

SEQ ID NO: 2083 - protein, 12 aa, Homo sapiens
GIVEQCCTSICS

SEQ ID NO: 2084 - protein, 23 aa, Mus musculus
GRHSAEYYNKQYLERTRAELDTA

SEQ ID NO: 2085 - protein, 9 aa, Homo sapiens
ILMHCQTTL

SEQ ID NO: 2086 - protein, 7 aa, unidentified
  REGION 1..7: note = epitope involved in diabetes
LDQRSSK

SEQ ID NO: 2087 - protein, 7 aa, unidentified
  REGION 1..7: note = epitope involved in diabetes
LDQSRLK

SEQ ID NO: 2088 - protein, 19 aa, Mus musculus
LKICGFLQRTNSLEEKSRL

SEQ ID NO: 2089 - protein, 7 aa, unidentified
  REGION 1..7: note = epitope involved in diabetes
LPGERQI

SEQ ID NO: 2090 - protein, 7 aa, unidentified
  REGION 1..7: note = epitope involved in diabetes
LPNRSQI

SEQ ID NO: 2091 - protein, 7 aa, unidentified
  REGION 1..7: note = epitope involved in diabetes
NIKSSLP

SEQ ID NO: 2092 - protein, 7 aa, unidentified
  REGION 1..7: note = epitope involved in diabetes
NPGSSLG

SEQ ID NO: 2093 - protein, 17 aa, Mus musculus
NSQPEILERTRAEVDTA

SEQ ID NO: 2094 - protein, 7 aa, unidentified
  REGION 1..7: note = epitope involved in diabetes
PDGSRLV

SEQ ID NO: 2095 - protein, 7 aa, unidentified
  REGION 1..7: note = epitope involved in diabetes
PGSRLQP

SEQ ID NO: 2096 - protein, 7 aa, unidentified
  REGION 1..7: note = epitope involved in diabetes
PGTRLQP

SEQ ID NO: 2097 - protein, 7 aa, unidentified
  REGION 1..7: note = epitope involved in diabetes
PSRLVNQ

SEQ ID NO: 2098 - protein, 12 aa, Bos taurus
QCCASVCSLYQL

SEQ ID NO: 2099 - protein, 12 aa, Homo sapiens
QCCTSICSLYQL

SEQ ID NO: 2100 - protein, 7 aa, unidentified
  REGION 1..7: note = epitope involved in diabetes
QGERSGP

SEQ ID NO: 2101 - protein, 7 aa, unidentified
  REGION 1..7: note = epitope involved in diabetes
QRSGRGP

SEQ ID NO: 2102 - protein, 15 aa, unidentified
  REGION 1..15: note = epitope involved in diabetes
SHLVEALALVAGERG

SEQ ID NO: 2103 - protein, 8 aa, Mus musculus
SHLVEALY

SEQ ID NO: 2104 - protein, 7 aa, unidentified
  REGION 1..7: note = epitope involved in diabetes
STGERIQ

SEQ ID NO: 2105 - protein, 20 aa, Homo sapiens
TNMFTYEIAPVFVLLEYVTL

SEQ ID NO: 2106 - protein, 13 aa, Bos taurus
VCGERGFFYTPKA

SEQ ID NO: 2107 - protein, 7 aa, unidentified
  REGION 1..7: note = epitope involved in diabetes
VGERGSK

SEQ ID NO: 2108 - protein, 7 aa, unidentified
  REGION 1..7: note = epitope involved in diabetes
VIQGSQL

SEQ ID NO: 2109 - protein, 7 aa, unidentified
  REGION 1..7: note = epitope involved in diabetes
VIQGSRL

SEQ ID NO: 2110 - protein, 24 aa, Mus musculus
VLGGGCALLRCIPALDSLKPANED

SEQ ID NO: 2111 - protein, 7 aa, unidentified
  REGION 1..7: note = epitope involved in diabetes
VPQQSIP

SEQ ID NO: 2112 - protein, 7 aa, unidentified
  REGION 1..7: note = epitope involved in diabetes
VRGRGSK

SEQ ID NO: 2113 - protein, 7 aa, unidentified
  REGION 1..7: note = epitope involved in diabetes
VSRSLLD

SEQ ID NO: 2114 - protein, 585 aa, Homo sapiens; identical to SEQ ID NO: 1841

SEQ ID NO: 2115 - protein, 30 aa, Homo sapiens
AAAFVNQHLCGSHLVEALYLVCGERGFFYT

SEQ ID NO: 2116 - protein, 9 aa, Mus musculus
ALIPYCVHM

SEQ ID NO: 2117 - protein, 9 aa, Mus musculus
ALSYTISRM

SEQ ID NO: 2118 - protein, 9 aa, Mus musculus
ATHFPHQVI

SEQ ID NO: 2119 - protein, 9 aa, Mus musculus
CALTSLTTM

SEQ ID NO: 2120 - protein, 9 aa, Mus musculus
CANPDWIHI

SEQ ID NO: 2121 - protein, 21 aa, Homo sapiens
CGRHVDVFKLWLMWRAKGTTG

SEQ ID NO: 2122 - protein, 9 aa, Mus musculus
CKSASIPLM

SEQ ID NO: 2123 - protein, 9 aa, Mus musculus
CQGENGTKP

SEQ ID NO: 2124 - protein, 20 aa, Homo sapiens
DERGKMIPSDLERRILEAKQ

SEQ ID NO: 2125 - protein, 9 aa, Mus musculus
DFLHRSGVL

SEQ ID NO: 2126 - protein, 12 aa, unidentified
  REGION 1..12: note = epitope involved in diabetes
DSYEIMQGRAVV

SEQ ID NO: 2127 - protein, 9 aa, Mus musculus
DYRTYYGFL

SEQ ID NO: 2128 - protein, 20 aa, Homo sapiens
EEILMHCQTTLKYAIKTGHP

SEQ ID NO: 2129 - protein, 20 aa, Homo sapiens
ERANSVTWNPHKMMGVPLQC

SEQ ID NO: 2130 - protein, 9 aa, Mus musculus
ESSVTLHRL

SEQ ID NO: 2131 - protein, 20 aa, Homo sapiens
EYGTTMVSYQPLGDKVNFFR

SEQ ID NO: 2132 - protein, 20 aa, Homo sapiens
EYLYNIIKNREGYEMVFDGK

SEQ ID NO: 2133 - protein, 9 aa, Mus musculus
FAINSEMFL

SEQ ID NO: 2134 - protein, 9 aa, Mus musculus
FEHTPGVHM

SEQ ID NO: 2135 - protein, 9 aa, Mus musculus
FGIDLLWSV

SEQ ID NO: 2136 - protein, 9 aa, Mus musculus
FLHRSGVLI

SEQ ID NO: 2137 - protein, 9 aa, Homo sapiens
FLWSVFWLI

SEQ ID NO: 2138 - protein, 9 aa, Mus musculus
GDPRNIFSI

SEQ ID NO: 2139 - protein, 9 aa, Mus musculus
GFAINSEMF

SEQ ID NO: 2140 - protein, 20 aa, Homo sapiens
GGSGDGIFSPGGAISNMYAM

SEQ ID NO: 2141 - protein, 9 aa, Mus musculus
GHAMGSSCV

SEQ ID NO: 2142 - protein, 9 aa, Mus musculus
GLVRNLGVL

SEQ ID NO: 2143 - protein, 9 aa, Mus musculus
GTKPSFRLL

SEQ ID NO: 2144 - protein, 9 aa, Mus musculus
HAEPLFYLL

SEQ ID NO: 2145 - protein, 9 aa, Mus musculus
HMASLSVYL

SEQ ID NO: 2146 - protein, 9 aa, Mus musculus
IYFPLWFQL

SEQ ID NO: 2147 - protein, 9 aa, Mus musculus
IYPNHSSPC

SEQ ID NO: 2148 - protein, 22 aa, Homo sapiens
KGTTGFEAHVDKCLELAEYLYN

SEQ ID NO: 2149 - protein, 9 aa, Mus musculus
KIPTHAEPL

SEQ ID NO: 2150 - protein, 20 aa, Homo sapiens
KTGHPRYFNQLSTGLDMVGL

SEQ ID NO: 2151 - protein, 9 aa, Mus musculus
KWCANPDWI

SEQ ID NO: 2152 - protein, 22 aa, Homo sapiens
LAFLQDVMNILLQYVVKSFDRS

SEQ ID NO: 2153 - protein, 20 aa, Homo sapiens
LEAKQKGFVPFLVSATAGTT

SEQ ID NO: 2154 - protein, 9 aa, Mus musculus
LGFAINSEM

SEQ ID NO: 2155 - protein, 20 aa, Homo sapiens
LLYGDAEKPAESGGSQPPRA

SEQ ID NO: 2156 - protein, 9 aa, Mus musculus
LRLFGIDLL

SEQ ID NO: 2157 - protein, 9 aa, Mus musculus
LSFCKSASI

SEQ ID NO: 2158 - protein, 9 aa, Mus musculus
LSVYLKTNV

SEQ ID NO: 2159 - protein, 9 aa, Mus musculus
LTSLTTMQL

SEQ ID NO: 2160 - protein, 9 aa, Mus musculus
MQLYRFIKI

SEQ ID NO: 2161 - protein, 11 aa, unidentified
  REGION 1..11: note = epitope involved in diabetes
MYELLQPAAIV

SEQ ID NO: 2162 - protein, 9 aa, Homo sapiens
NLFLFLFAV

SEQ ID NO: 2163 - protein, 9 aa, Mus musculus
NQNVGTKMI

SEQ ID NO: 2164 - protein, 20 aa, Homo sapiens
PEVKEKGMAALPRLIAFTSE

SEQ ID NO: 2165 - protein, 14 aa, Mus musculus
PSLWEIEFAKQLAS

SEQ ID NO: 2166 - protein, 9 aa, Mus musculus
QLNQNVGTK

SEQ ID NO: 2167 - protein, 20 aa, Homo sapiens
QNCNQMHASYLFQQDKHYDL

SEQ ID NO: 2168 - protein, 9 aa, Mus musculus
RFIKIPTHA

SEQ ID NO: 2169 - protein, 9 aa, Mus musculus
RMEESSVTL

SEQ ID NO: 2170 - protein, 9 aa, Mus musculus
SFCKSASIP

SEQ ID NO: 2171 - protein, 9 aa, Mus musculus
SFLWSVFWL

SEQ ID NO: 2172 - protein, 9 aa, Mus musculus
SRMEESSVT

SEQ ID NO: 2173 - protein, 9 aa, Mus musculus
SRVFIATHF

SEQ ID NO: 2174 - protein, 9 aa, Mus musculus
THAEPLFYL

SEQ ID NO: 2175 - protein, 9 aa, Mus musculus
THFPHQVIL

SEQ ID NO: 2176 - protein, 9 aa, Mus musculus
TSLTTMQLY

SEQ ID NO: 2177 - protein, 9 aa, Mus musculus
TYYGFLNFM

SEQ ID NO: 2178 - protein, 30 aa, Homo sapiens
VCGERGFFYTPKTRREAEDLQVGQVELGGG

SEQ ID NO: 2179 - protein, 9 aa, Mus musculus
VFWLIQISV

SEQ ID NO: 2180 - protein, 9 aa, Mus musculus
YLKTNVFLF

SEQ ID NO: 2181 - protein, 9 aa, Homo sapiens
YLLLRVLNI

SEQ ID NO: 2182 - protein, 9 aa, Mus musculus
YPNHSSPCL

SEQ ID NO: 2183 - protein, 9 aa, Mus musculus
YTISRMEES

SEQ ID NO: 2184 - protein, 10 aa, unidentified
  REGION 1..10: note = epitope involved in diabetes
YVRPLWVRME

SEQ ID NO: 2185 - protein, 10 aa, Homo sapiens
ALWMRLLPLL

SEQ ID NO: 2186 - protein, 13 aa, Homo sapiens
DWIHIDTTPFAGL

SEQ ID NO: 2187 - protein, 13 aa, Homo sapiens
EWVHIDTTPFASL

SEQ ID NO: 2188 - protein, 9 aa, Homo sapiens
FYTPKTRRE

SEQ ID NO: 2189 - protein, 8 aa, Homo sapiens
GERGFFYT

SEQ ID NO: 2190 - protein, 9 aa, Homo sapiens
LPLLALLAL

SEQ ID NO: 2191 - protein, 9 aa, Homo sapiens
LWMRLLPLL

SEQ ID NO: 2192 - protein, 5 aa, Homo sapiens
PAEGT

SEQ ID NO: 2193 - protein, 13 aa, Homo sapiens
QHLQKDYRAYYTF

SEQ ID NO: 2194 - protein, 13 aa, Homo sapiens
RVLNIDLLWSVPI

SEQ ID NO: 2195 - protein, 31 aa, Homo sapiens
WCEDFLVRSFYLKNVQTQETRTLTQFHFLSW

SEQ ID NO: 2196 - protein, 10 aa, Homo sapiens
WMRLLPLLAL

SEQ ID NO: 2197 - protein, 13 aa, Homo sapiens
YTFLNFMSNVGDP

SEQ ID NO: 2198 - protein, 979 aa, Homo sapiens; identical to SEQ ID NO: 2028

SEQ ID NO: 2199 - protein, 15 aa, Mus musculus
AELNQLRAKEPTKLA

SEQ ID NO: 2200 - protein, 15 aa, Mus musculus
ELRELRLRLDQLTAN

SEQ ID NO: 2201 - protein, 9 aa, Homo sapiens
ERGFFYTPK

SEQ ID NO: 2202 - protein, 7 aa, Mus musculus
GLAPSGA

SEQ ID NO: 2203 - protein, 10 aa, Homo sapiens
LCGSHLVEAL

SEQ ID NO: 2204 - protein, 10 aa, Homo sapiens
LVCGERGFFY

SEQ ID NO: 2205 - protein, 10 aa, Homo sapiens
LYLVCGERGF

SEQ ID NO: 2206 - protein, 15 aa, Mus musculus
QVHVEMDVAKPDLTA

SEQ ID NO: 2207 - protein, 9 aa, Mus musculus
WYRSKFADL

SEQ ID NO: 2208 - protein, 13 aa, Bos taurus
FKADEKKFWGKYL

SEQ ID NO: 2209 - protein, 9 aa, Homo sapiens
QMRPVSRVL

SEQ ID NO: 2210 - protein, 5 aa, Bos taurus
ADEKK

SEQ ID NO: 2211 - protein, 16 aa, Bos taurus
ADEKKFWGKYLYEIAR

SEQ ID NO: 2212 - protein, 5 aa, Bos taurus
EFKAD

SEQ ID NO: 2213 - protein, 6 aa, Bos taurus
EFKADE

SEQ ID NO: 2214 - protein, 8 aa, Bos taurus
EFKADEKK

SEQ ID NO: 2215 - protein, 6 aa, Bos taurus
FKADEK

SEQ ID NO: 2216 - protein, 9 aa, Simian immunodeficiency virus
FYCKMNWFL

SEQ ID NO: 2217 - protein, 9 aa, Aquifex aeolicus
GFIKNFWFI

SEQ ID NO: 2218 - protein, 9 aa, Helicobacter pylori
GYNKAMGFL

SEQ ID NO: 2219 - protein, 9 aa, Helicobacter pylori
IFFKTSSFL

SEQ ID NO: 2220 - protein, 9 aa, Saccharomyces cerevisiae
IYQKANTFL

SEQ ID NO: 2221 - protein, 9 aa, Helicobacter pylori
IYVKTSSFL

SEQ ID NO: 2222 - protein, 6 aa, Bos taurus
KADEKK

SEQ ID NO: 2223 - protein, 9 aa, Borrelia burgdorferi
KYNKNGNFL

SEQ ID NO: 2224 - protein, 9 aa, Haemophilus influenzae
KYYKNSQFL

SEQ ID NO: 2225 - protein, 9 aa, Saccharomyces cerevisiae
KYYKTSNFL

SEQ ID NO: 2226 - protein, 18 aa, Bos taurus
LPKLKPDPNTLCDEFKAD

SEQ ID NO: 2227 - protein, 9 aa, Borrelia burgdorferi
LYSKNLVFL

SEQ ID NO: 2228 - protein, 9 aa, Methanothermobacter thermautotrophicus
NFMKTAGFI

SEQ ID NO: 2229 - protein, 9 aa, Rickettsia prowazekii
QYNKTGYFI

SEQ ID NO: 2230 - protein, 9 aa, Langat virus
RFSKALYFL

SEQ ID NO: 2231 - protein, 9 aa, Escherichia coli
RYQKAGVML

SEQ ID NO: 2232 - protein, 9 aa, Aquifex aeolicus
TYLKNAQFV

SEQ ID NO: 2233 - protein, 9 aa, Drosophila melanogaster
VYVKTSSFI

SEQ ID NO: 2234 - protein, 9 aa, Haemophilus influenzae
YFLKCGYFL

SEQ ID NO: 2235 - protein, 9 aa, Sonchus yellow net virus
YYNKALSFI

SEQ ID NO: 2236 - protein, 21 aa, Homo sapiens
HGDTTFEYQDLCRQHMATKSL

SEQ ID NO: 2237 - protein, 21 aa, Homo sapiens
RLAALGPEGAHGDTTFEYQDL

SEQ ID NO: 2238 - protein, 20 aa, Homo sapiens
RQHARQQDKERLAALGPEGA

SEQ ID NO: 2239 - protein, 42 aa, Homo sapiens
RQHARQQDKERLAALGPEGAHGDTTFEYQDLCRQHMATKSLF

SEQ ID NO: 2240 - protein, 16 aa, Mus musculus
QCCTSICSLYQLENYC

SEQ ID NO: 2241 - protein, 12 aa, Bos taurus
EDKGACLLPKIE

SEQ ID NO: 2242 - protein, 30 aa, Homo sapiens
FFRMVISNPAATHQDIDFLIEEIERLGQDL

SEQ ID NO: 2243 - protein, 41 aa, Homo sapiens
GGAISNMYAMMIARFKMFPEVKEKGMAALPRLIAFTSEHSH

SEQ ID NO: 2244 - protein, 9 aa, unidentified
  REGION 1..9: note = epitope involved in diabetes
LYLVCGERL

SEQ ID NO: 2245 - protein, 17 aa, Homo sapiens
NIIKNREGYEMVFDGKP

SEQ ID NO: 2246 - protein, 4 aa, Homo sapiens
PGGS

SEQ ID NO: 2247 - protein, 9 aa, Homo sapiens
VIKARMMEY

SEQ ID NO: 2248 - protein, 9 aa, unidentified
  REGION 1..9: note = epitope involved in diabetes
YAIENYLEL

SEQ ID NO: 2249 - protein, 585 aa, Homo sapiens; identical to SEQ ID NO: 1841

SEQ ID NO: 2250 - protein, 12 aa, Mus musculus
LYFCAARSNYQL

SEQ ID NO: 2251 - protein, 15 aa, Homo sapiens
AYVLLSEKKISSIQS

SEQ ID NO: 2252 - protein, 15 aa, Homo sapiens
GEALSTLVLNRLKVG

SEQ ID NO: 2253 - protein, 15 aa, Mycobacterium sp.
GEALSTLVVNKIRGT

SEQ ID NO: 2254 - protein, 11 aa, Homo sapiens
ALWGPDPAAAF

SEQ ID NO: 2255 - protein, 10 aa, Homo sapiens
LALWGPDPAA

SEQ ID NO: 2256 - protein, 11 aa, Homo sapiens
RLLPLLALLAL

SEQ ID NO: 2257 - protein, 42 aa, Homo sapiens
IAATLEHVRDQRPGLVRSKDQFEFALTAVAEEVNAILKALPQ

SEQ ID NO: 2258 - protein, 9 aa, Homo sapiens
NLAQDLATV

SEQ ID NO: 2259 - protein, 9 aa, Homo sapiens
QLARQQVHV

SEQ ID NO: 2260 - protein, 979 aa, Homo sapiens; identical to SEQ ID NO: 2028

SEQ ID NO: 2261 - protein, 12 aa, Human coxsackievirus
EWLKVKILPEVK

SEQ ID NO: 2262 - protein, 20 aa, Enterovirus A
WLKVKILPEVKEKHEFLNRL

SEQ ID NO: 2263 - protein, 15 aa, Human Endogenous Retrovirus
GKTCPKEIPKGSKNT

SEQ ID NO: 2264 - protein, 23 aa, Homo sapiens
ARFKMFPEVKEKGMAALPRLIAF

SEQ ID NO: 2265 - protein, 23 aa, Human coxsackievirus
LKVKILPEVKEKHEFLSRLKQLP

SEQ ID NO: 2266 - protein, 10 aa, unidentified
  REGION 1..10: note = epitope involved in diabetes
SLYQLENYCA

SEQ ID NO: 2267 - protein, 13 aa, Mus musculus
YKMFPEVKEKGMA

SEQ ID NO: 2268 - protein, 13 aa, Mus musculus
YKYFPEVKTKGMA

SEQ ID NO: 2269 - protein, 9 aa, unidentified
  REGION 1..9: note = epitope involved in diabetes
ARKVKGAAG

SEQ ID NO: 2270 - protein, 9 aa, unidentified
  REGION 1..9: note = epitope involved in diabetes
ARLSVVRNG

SEQ ID NO: 2271 - protein, 21 aa, Homo sapiens
DKVNFFRMVISNPAATHQDID

SEQ ID NO: 2272 - protein, 9 aa, unidentified
  REGION 1..9: note = epitope involved in diabetes
FRKADKFPM

SEQ ID NO: 2273 - protein, 9 aa, unidentified
  REGION 1..9: note = epitope involved in diabetes
FRKTSISGA

SEQ ID NO: 2274 - protein, 9 aa, unidentified
  REGION 1..9: note = epitope involved in diabetes
FRKTSKGGS

SEQ ID NO: 2275 - protein, 9 aa, unidentified
  REGION 1..9: note = epitope involved in diabetes
GGTTTPRTT

SEQ ID NO: 2276 - protein, 9 aa, unidentified
  REGION 1..9: note = epitope involved in diabetes
GRKSAVSPA

SEQ ID NO: 2277 - protein, 9 aa, unidentified
  REGION 1..9: note = epitope involved in diabetes
HKKSLSSPS

SEQ ID NO: 2278 - protein, 9 aa, unidentified
  REGION 1..9: note = epitope involved in diabetes
HRKSTVAGS

SEQ ID NO: 2279 - protein, 9 aa, unidentified
  REGION 1..9: note = epitope involved in diabetes
KGKKALQSA

SEQ ID NO: 2280 - protein, 9 aa, unidentified
  REGION 1..9: note = epitope involved in diabetes
KKKKYAEAV

SEQ ID NO: 2281 - protein, 9 aa, unidentified
  REGION 1..9: note = epitope involved in diabetes
KKTKGLVTT

SEQ ID NO: 2282 - protein, 9 aa, unidentified
  REGION 1..9: note = epitope involved in diabetes
KRRASAGGP

SEQ ID NO: 2283 - protein, 9 aa, unidentified
  REGION 1..9: note = epitope involved in diabetes
KSVKPRQAT

SEQ ID NO: 2284 - protein, 9 aa, unidentified
  REGION 1..9: note = epitope involved in diabetes
LRKKGYDPG

SEQ ID NO: 2285 - protein, 9 aa, unidentified
  REGION 1..9: note = epitope involved in diabetes
LSRKKTLTT

SEQ ID NO: 2286 - protein, 13 aa, Homo sapiens
MFPEVKEKGMAAL

SEQ ID NO: 2287 - protein, 9 aa, unidentified
  REGION 1..9: note = epitope involved in diabetes
MRKANSPPT

SEQ ID NO: 2288 - protein, 9 aa, unidentified
  REGION 1..9: note = epitope involved in diabetes
MRKSTGTAS

SEQ ID NO: 2289 - protein, 9 aa, unidentified
  REGION 1..9: note = epitope involved in diabetes
NRKLKSNMM

SEQ ID NO: 2290 - protein, 9 aa, unidentified
  REGION 1..9: note = epitope involved in diabetes
NRRLLPMPE

SEQ ID NO: 2291 - protein, 9 aa, unidentified
  REGION 1..9: note = epitope involved in diabetes
QKKMVALSG

SEQ ID NO: 2292 - protein, 9 aa, unidentified
  REGION 1..9: note = epitope involved in diabetes
QKRAKGLSA

SEQ ID NO: 2293 - protein, 9 aa, unidentified
  REGION 1..9: note = epitope involved in diabetes
RGLKSKIAM

SEQ ID NO: 2294 - protein, 9 aa, unidentified
  REGION 1..9: note = epitope involved in diabetes
RKKKPPGLA

SEQ ID NO: 2295 - protein, 9 aa, unidentified
  REGION 1..9: note = epitope involved in diabetes
RKLAHPGTS

SEQ ID NO: 2296 - protein, 9 aa, unidentified
  REGION 1..9: note = epitope involved in diabetes
RKRTRHLEG

SEQ ID NO: 2297 - protein, 9 aa, unidentified
  REGION 1..9: note = epitope involved in diabetes
RKTALGTRQ

SEQ ID NO: 2298 - protein, 9 aa, unidentified
  REGION 1..9: note = epitope involved in diabetes
RKVVQTSLE

SEQ ID NO: 2299 - protein, 9 aa, unidentified
  REGION 1..9: note = epitope involved in diabetes
RRKLRTNAG

SEQ ID NO: 2300 - protein, 9 aa, unidentified
  REGION 1..9: note = epitope involved in diabetes
RRKPGTEQL

SEQ ID NO: 2301 - protein, 9 aa, unidentified
  REGION 1..9: note = epitope involved in diabetes
RSLKTKLPS

SEQ ID NO: 2302 - protein, 9 aa, unidentified
  REGION 1..9: note = epitope involved in diabetes
SRKATASLP

SEQ ID NO: 2303 - protein, 9 aa, unidentified
  REGION 1..9: note = epitope involved in diabetes
SRKKTFTGA

SEQ ID NO: 2304 - protein, 9 aa, unidentified
  REGION 1..9: note = epitope involved in diabetes
SRKSGSLTK

SEQ ID NO: 2305 - protein, 9 aa, unidentified
  REGION 1..9: note = epitope involved in diabetes
SRKVALQGG

SEQ ID NO: 2306 - protein, 9 aa, unidentified
  REGION 1..9: note = epitope involved in diabetes
TKLSNTPSP

SEQ ID NO: 2307 - protein, 9 aa, unidentified
  REGION 1..9: note = epitope involved in diabetes
TQDLGYSRV

SEQ ID NO: 2308 - protein, 9 aa, unidentified
  REGION 1..9: note = epitope involved in diabetes
TRGLKGAPQ

SEQ ID NO: 2309 - protein, 9 aa, unidentified
  REGION 1..9: note = epitope involved in diabetes
TRKALTQNT

SEQ ID NO: 2310 - protein, 20 aa, Homo sapiens
VFDGKPQHTNVCFWYIPPSL

SEQ ID NO: 2311 - protein, 20 aa, Homo sapiens
VNFFRMVISNPAATHQDIDF

SEQ ID NO: 2312 - protein, 9 aa, unidentified
  REGION 1..9: note = epitope involved in diabetes
VRKLTVTSA

SEQ ID NO: 2313 - protein, 9 aa, unidentified
  REGION 1..9: note = epitope involved in diabetes
YKKGARPIQ

SEQ ID NO: 2314 - protein, 9 aa, unidentified
  REGION 1..9: note = epitope involved in diabetes
YRKKSSAEL

SEQ ID NO: 2315 - protein, 9 aa, unidentified
  REGION 1..9: note = epitope involved in diabetes
YRKTAKEGT

SEQ ID NO: 2316 - protein, 29 aa, Rubella virus
EACVTSWLWSEGEGAVFYRVDLHFINLGT

SEQ ID NO: 2317 - protein, 21 aa, Rubella virus
MDFWCVEHDRPPPATPTSLTT

SEQ ID NO: 2318 - protein, 15 aa, Homo sapiens
NMFTYEIAPVFVLME

SEQ ID NO: 2319 - protein, 25 aa, Rubella virus
PFLGHDGHHGGTLRVGQHHRNASDV

SEQ ID NO: 2320 - protein, 21 aa, Rubella virus
RVKFHTETRTVWQLSVAGVSC

SEQ ID NO: 2321 - protein, 16 aa, Human coxsackievirus
KILPEVKEKHEFLSRL

SEQ ID NO: 2322 - protein, 17 aa, Homo sapiens
KMFPEVKEKGMAALPRL

SEQ ID NO: 2323 - protein, 17 aa, Homo sapiens
KYFPEVKTKGMAAVPKL

SEQ ID NO: 2324 - protein, 7 aa, unidentified
  REGION 1..7: note = epitope involved in diabetes
KRSRLDV

SEQ ID NO: 2325 - protein, 7 aa, unidentified
  REGION 1..7: note = epitope involved in diabetes
LGRGGSK

SEQ ID NO: 2326 - protein, 7 aa, unidentified
  REGION 1..7: note = epitope involved in diabetes
RLGKRDS

SEQ ID NO: 2327 - protein, 7 aa, unidentified
  REGION 1..7: note = epitope involved in diabetes
RQLGRGS

SEQ ID NO: 2328 - protein, 7 aa, unidentified
  REGION 1..7: note = epitope involved in diabetes
STVQDCV

SEQ ID NO: 2329 - protein, 7 aa, unidentified
  REGION 1..7: note = epitope involved in diabetes
YLGRGDK

SEQ ID NO: 2330 - protein, 12 aa, Photobacterium phosphoreum
AKVAIVIARFNS

SEQ ID NO: 2331 - protein, 12 aa, Human herpesvirus
GGVAVVIGRFFG

SEQ ID NO: 2332 - protein, 12 aa, Synechocystis sp.
SAIGIYLGRFLR

SEQ ID NO: 2333 - protein, 10 aa, Mus musculus
HLCGPHLVEA

SEQ ID NO: 2334 - protein, 9 aa, Mus musculus
IVDQCCTSI

SEQ ID NO: 2335 - protein, 9 aa, Mus musculus
LLVHFLPLL

SEQ ID NO: 2336 - protein, 13 aa, Streptococcus pneumoniae
DDIMMSYAAKGFV

SEQ ID NO: 2337 - protein, 13 aa, Rickettsia prowazekii
ELVLMSYRDKLVL

SEQ ID NO: 2338 - protein, 13 aa, Human herpesvirus
KELLQSYVSKNNN

SEQ ID NO: 2339 - protein, 13 aa, Legionella pneumophila
KMSLLQYIVKNKI

SEQ ID NO: 2340 - protein, 13 aa, Lactococcus lactis
LVILPMFHVSGLS

SEQ ID NO: 2341 - protein, 13 aa, Homo sapiens
PIILPLWHVGEPG

SEQ ID NO: 2342 - protein, 13 aa, Homo sapiens
PIILPLWHVGMND

SEQ ID NO: 2343 - protein, 13 aa, Neisseria meningitidis
PVILPQWQSLGNR

SEQ ID NO: 2344 - protein, 13 aa, Staphylococcus aureus
PYVLLAYIVKSVG

SEQ ID NO: 2345 - protein, 13 aa, Chlamydia pneumoniae
QAMNILYQTVQAF

SEQ ID NO: 2346 - protein, 13 aa, Streptococcus pyogenes
REILPQYQLVILA

SEQ ID NO: 2347 - protein, 13 aa, Homo sapiens
TTLLPQWRVSAFV

SEQ ID NO: 2348 - protein, 12 aa, Homo sapiens
AYAKDVKFGADA

SEQ ID NO: 2349 - protein, 13 aa, Mus musculus
LSKVAPVIKARMM

SEQ ID NO: 2350 - protein, 10 aa, unidentified
  REGION 1..10: note = epitope involved in diabetes
SRLGLWVRME

SEQ ID NO: 2351 - protein, 14 aa, Mus musculus
WSRMDQLAKELTAE

SEQ ID NO: 2352 - protein, 18 aa, Mus musculus
FLPLLALLALWEPKPTQA

SEQ ID NO: 2353 - protein, 20 aa, Homo sapiens
GGGPGAGSLQPLALEGSLQK

SEQ ID NO: 2354 - protein, 24 aa, Homo sapiens
KLKVESSPSRSDYINASPIIEHDP

SEQ ID NO: 2355 - protein, 28 aa, Homo sapiens
LAKEWQALCAYQAEPNTCATAQGEGNIK

SEQ ID NO: 2356 - protein, 20 aa, Homo sapiens
SFYLKNVQTQETRTLTQFHF

SEQ ID NO: 2357 - protein, 22 aa, Homo sapiens
SKDQFEFALTAVAEEVNAILKA

SEQ ID NO: 2358 - protein, 29 aa, Homo sapiens
SRVSSVSSQFSDAAQASPSSHSSTPSWCE

SEQ ID NO: 2359 - protein, 12 aa, Homo sapiens
AFLQDVMNILLQ

SEQ ID NO: 2360 - protein, 19 aa, Homo sapiens
ALLRCIPALDSLTPANEDC

SEQ ID NO: 2361 - protein, 12 aa, Homo sapiens
APKRPGPAGELL

SEQ ID NO: 2362 - protein, 12 aa, Human coxsackievirus
ATCRFYTLDSIK

SEQ ID NO: 2363 - protein, 12 aa, Human coxsackievirus
DINTVTTVAQSR

SEQ ID NO: 2364 - protein, 12 aa, Human coxsackievirus
DRVRSITLGNST

SEQ ID NO: 2365 - protein, 12 aa, Homo sapiens
EEIAQVATISAN

SEQ ID NO: 2366 - protein, 12 aa, Human coxsackievirus
ETSLSAAGNSII

SEQ ID NO: 2367 - protein, 12 aa, Homo sapiens
FFRMVISNPAAT

SEQ ID NO: 2368 - protein, 12 aa, Homo sapiens
GADIKKTMEGPV

SEQ ID NO: 2369 - protein, 12 aa, Homo sapiens
GVELRQLTPEQL

SEQ ID NO: 2370 - protein, 12 aa, Homo sapiens
KDVKFGADARAL

SEQ ID NO: 2371 - protein, 16 aa, Homo sapiens
KEQFEFALTAVAEEVC

SEQ ID NO: 2372 - protein, 12 aa, Homo sapiens
KFGADARALMLQ

SEQ ID NO: 2373 - protein, 12 aa, Homo sapiens
KTGHPRYFNQLS

SEQ ID NO: 2374 - protein, 12 aa, Human coxsackievirus
LLESQIATIEQT

SEQ ID NO: 2375 - protein, 12 aa, Homo sapiens
LLQYVVKSFDRS

SEQ ID NO: 2376 - protein, 12 aa, Homo sapiens
LRLLLCLLLLSS

SEQ ID NO: 2377 - protein, 12 aa, Homo sapiens
LRQLTPEQLSTL

SEQ ID NO: 2378 - protein, 12 aa, Human coxsackievirus
LTAVETGHTSQV

SEQ ID NO: 2379 - protein, 12 aa, Homo sapiens
LTRAYAKDVKFG

SEQ ID NO: 2380 - protein, 12 aa, Homo sapiens
PPEPRPRDRSGL

SEQ ID NO: 2381 - protein, 12 aa, Homo sapiens
PRPRDRSGLAPK

SEQ ID NO: 2382 - protein, 12 aa, Human coxsackievirus
PSNSASVPALTA

SEQ ID NO: 2383 - protein, 12 aa, Homo sapiens
PTLAFLQDVMNI

SEQ ID NO: 2384 - protein, 23 aa, Human coxsackievirus
PVKDVMIKSLPAPALNSPTVEEC

SEQ ID NO: 2385 - protein, 12 aa, Homo sapiens
RDRSGLAPKRPG

SEQ ID NO: 2386 - protein, 12 aa, Homo sapiens
RLRPPEPRPRDR

SEQ ID NO: 2387 - protein, 12 aa, Human coxsackievirus
RSGPSNSASVPA

SEQ ID NO: 2388 - protein, 12 aa, Human coxsackievirus
RSITLGNSTITT

SEQ ID NO: 2389 - protein, 12 aa, Homo sapiens
RTALLDAAGVAS

SEQ ID NO: 2390 - protein, 12 aa, Human coxsackievirus
SASVPALTAVET

SEQ ID NO: 2391 - protein, 12 aa, Homo sapiens
SGGLRLLLCLLL

SEQ ID NO: 2392 - protein, 12 aa, Homo sapiens
SGLAPKRPGPAG

SEQ ID NO: 2393 - protein, 12 aa, Human coxsackievirus
SLEKKMSNYIQF

SEQ ID NO: 2394 - protein, 12 aa, Human coxsackievirus
SQIATIEQTAPS

SEQ ID NO: 2395 - protein, 12 aa, Human coxsackievirus
TKQMVQMRRKLE

SEQ ID NO: 2396 - protein, 12 aa, Human coxsackievirus
TRKDINTVTTVA

SEQ ID NO: 2397 - protein, 12 aa, Human coxsackievirus
VETGHTSQVTPS

SEQ ID NO: 2398 - protein, 12 aa, Homo sapiens
VKEKGMAALPRL

SEQ ID NO: 2399 - protein, 17 aa, Human coxsackievirus
VMIKSLPALNSPTVEEC

SEQ ID NO: 2400 - protein, 12 aa, Human coxsackievirus
VPALTAVETGHT

SEQ ID NO: 2401 - protein, 14 aa, Mus musculus
EYVTLKKMREIIGW

SEQ ID NO: 2402 - protein, 20 aa, Homo sapiens
DVMNILLQYVVKSFDRSTKV

SEQ ID NO: 2403 - protein, 20 aa, Homo sapiens
GAGSLQPLALEGSLQKRGIV

SEQ ID NO: 2404 - protein, 20 aa, Homo sapiens
KDYRAYYTFLNFMSNVGDPR

SEQ ID NO: 2405 - protein, 20 aa, Homo sapiens
KVNFFRMVISNPAATHQDID

SEQ ID NO: 2406 - protein, 20 aa, Homo sapiens
LIAFTSEHSHFSLKKGAAAL

SEQ ID NO: 2407 - protein, 20 aa, Homo sapiens
RLQQLVLDPGFLGLEPLLDL

SEQ ID NO: 2408 - protein, 20 aa, Porphyromonas gingivalis
TLVVNRLRGSLKICAVKAPG

SEQ ID NO: 2409 - protein, 11 aa, unidentified
  REGION 1..11: note = epitope involved in diabetes
AHHPIWARMDA

SEQ ID NO: 2410 - protein, 14 aa, Mus musculus
DTKVMKCVLEVISD

SEQ ID NO: 2411 - protein, 20 aa, Homo sapiens
DSVILIKCDERGKMIPSDLE

SEQ ID NO: 2412 - protein, 20 aa, Homo sapiens
HKWKLSGVERANSVTWNPHK

SEQ ID NO: 2413 - protein, 20 aa, Homo sapiens
KCLELAEYLYNIIKNREGYE

SEQ ID NO: 2414 - protein, 20 aa, Homo sapiens
KGMAALPRLIAFTSEHSHFS

SEQ ID NO: 2415 - protein, 20 aa, Homo sapiens
RPTLAFLQDVMNILLQYVVK

SEQ ID NO: 2416 - protein, 20 aa, Homo sapiens
YDLSYDTGDKALQCGRHVDV

SEQ ID NO: 2417 - protein, 13 aa, Homo sapiens
IPALDSLTPANED

SEQ ID NO: 2418 - protein, 20 aa, Homo sapiens
PTIAFLQDVMNILLQYVVKS

SEQ ID NO: 2419 - protein, 15 aa, unidentified
  REGION 1..15: note = epitope involved in diabetes
SHLVEALYLVCGEEG

SEQ ID NO: 2420 - protein, 15 aa, unidentified
  REGION 1..15: note = epitope involved in diabetes
SHLVEALYLVCGGEG

SEQ ID NO: 2421 - protein, 369 aa, Homo sapiens
MEFLERTYLVNDKAAKMYAFTLESVELQQKPVNKDQCPRERPEELESGGMYHCHSGSKPTEKGANEYAYAKWKLCSASAICFIFMIAEVVGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 2422 - protein, 18 aa, Homo sapiens
LPRLIAFTSEHSHFSLKK

SEQ ID NO: 2423 - protein, 14 aa, Homo sapiens
VNFFRMVISNPAAT

SEQ ID NO: 2424 - protein, 10 aa, Homo sapiens
PLALEGSLQK

SEQ ID NO: 2425 - protein, 10 aa, Homo sapiens
PLLALLALWG

SEQ ID NO: 2426 - protein, 12 aa, Mus musculus
ASSLGGNQDTQY

SEQ ID NO: 2427 - protein, 9 aa, Homo sapiens
ALGDLFQSI

SEQ ID NO: 2428 - protein, 10 aa, Homo sapiens
AVAANIVLTV

SEQ ID NO: 2429 - protein, 10 aa, Homo sapiens
FLLSLFSLWL

SEQ ID NO: 2430 - protein, 9 aa, Homo sapiens
HIAGSLAVV

SEQ ID NO: 2431 - protein, 10 aa, Homo sapiens
ILAVDGVLSV

SEQ ID NO: 2432 - protein, 9 aa, Homo sapiens
ILKDFSILL

SEQ ID NO: 2433 - protein, 10 aa, Homo sapiens
ILVLASTITI

SEQ ID NO: 2434 - protein, 9 aa, Homo sapiens
LLIDLTSFL

SEQ ID NO: 2435 - protein, 9 aa, Homo sapiens
SISVLISAL

SEQ ID NO: 2436 - protein, 9 aa, Homo sapiens
VVTGVLVYL

SEQ ID NO: 2437 - protein, 9 aa, Homo sapiens
FIFSILVLA

SEQ ID NO: 2438 - protein, 9 aa, Homo sapiens
IQATVMIIV

SEQ ID NO: 2439 - protein, 9 aa, Homo sapiens
KMYAFTLES

SEQ ID NO: 2440 - protein, 9 aa, Homo sapiens
KSLNYSGVK

SEQ ID NO: 2441 - protein, 9 aa, Homo sapiens
LLSILCIWV

SEQ ID NO: 2442 - protein, 9 aa, Homo sapiens
LLSLFSLWL

SEQ ID NO: 2443 - protein, 9 aa, Homo sapiens
MIIVSSCAV

SEQ ID NO: 2444 - protein, 9 aa, Homo sapiens
RLLYPDYQI

SEQ ID NO: 2445 - protein, 9 aa, Homo sapiens
TMHSLTIQM

SEQ ID NO: 2446 - protein, 9 aa, Homo sapiens
VAANIVLTV

SEQ ID NO: 2447 - protein, 27 aa, Homo sapiens
ACERLLYPDYQIQATVMIIVSSCAVAA

SEQ ID NO: 2448 - protein, 27 aa, Homo sapiens
AKMHAFTLESVELQQKPVNKDQCPRER

SEQ ID NO: 2449 - protein, 27 aa, Homo sapiens
ANEYAYAKWKLCSASAICFIFMIAEVV

SEQ ID NO: 2450 - protein, 34 aa, Homo sapiens
ASRDSQVVRREIAKALSKSFTMHSLTIQMESPVD

SEQ ID NO: 2451 - protein, 27 aa, Homo sapiens
DGVLSVHSLHIWSLTMNQVILSAHVAT

SEQ ID NO: 2452 - protein, 27 aa, Homo sapiens
EELESGGMYHCHSGSKPTEKGANEYAY

SEQ ID NO: 2453 - protein, 41 aa, Homo sapiens
FGWHRAEILGALLSILCIWVVTGVLVYLACERLLYPDYQIQ

SEQ ID NO: 2454 - protein, 27 aa, Homo sapiens
FIFSILVLASTITILKDFSILLMEGVP

SEQ ID NO: 2455 - protein, 27 aa, Homo sapiens
GHIAGSLAVVTDAAHLLIDLTSFLLSL

SEQ ID NO: 2456 - protein, 27 aa, Homo sapiens
HLLIDLTSFLLSLFSLWLSSKPPSKRL

SEQ ID NO: 2457 - protein, 27 aa, Homo sapiens
HQRCLGHNHKEVQANASVRAAFVHALG

SEQ ID NO: 2458 - protein, 27 aa, Homo sapiens
LFQSISVLISALIIYFKPEYKIADPIC

SEQ ID NO: 2459 - protein, 27 aa, Homo sapiens
LKDFSILLMEGVPKSLNYSGVKELILA

SEQ ID NO: 2460 - protein, 27 aa, Homo sapiens
MEFLERTYLVNDKAAKMHAFTLESVEL

SEQ ID NO: 2461 - protein, 26 aa, Homo sapiens
MHSLTIQMESPVDQDPDCLFCEDPCD

SEQ ID NO: 2462 - protein, 27 aa, Homo sapiens
NASVRAAFVHALGDLFQSISVLISALI

SEQ ID NO: 2463 - protein, 27 aa, Homo sapiens
QKPVNKDQCPRERPEELESGGMYHCHS

SEQ ID NO: 2464 - protein, 27 aa, Homo sapiens
SAICFIFMIAEVVGGHIAGSLAVVTDA

SEQ ID NO: 2465 - protein, 27 aa, Homo sapiens
SCAVAANIVLTVVLHQRCLGHNHKEVQ

SEQ ID NO: 2466 - protein, 27 aa, Homo sapiens
SLNYSGVKELILAVDGVLSVHSLHIWS

SEQ ID NO: 2467 - protein, 27 aa, Homo sapiens
SLWLSSKPPSKRLTFGWHRAEILGALL

SEQ ID NO: 2468 - protein, 27 aa, Homo sapiens
TMNQVILSAHVATAASRDSQVVRREIA

SEQ ID NO: 2469 - protein, 27 aa, Homo sapiens
YFKPEYKIADPICTFIFSILVLASTIT

SEQ ID NO: 2470 - protein, 9 aa, Mus musculus
AINSEMFLR

SEQ ID NO: 2471 - protein, 10 aa, Mus musculus
LALEVARQKR

SEQ ID NO: 2472 - protein, 10 aa, Mus musculus
TLALEVAQQK

SEQ ID NO: 2473 - protein, 10 aa, Mus musculus
TLALEVARQK

SEQ ID NO: 2474 - protein, 20 aa, Mycobacterium tuberculosis
TLVVNKIRGTFKSVAVKAPG

SEQ ID NO: 2475 - protein, 20 aa, Chlamydia pneumoniae
TLVVNKLQGLLQVTVVTIPQ

SEQ ID NO: 2476 - protein, 14 aa, Homo sapiens
LTVGLTRRGQPRQY

SEQ ID NO: 2477 - protein, 13 aa, Homo sapiens
YNQYSQRYHQRTN

SEQ ID NO: 2478 - protein, 9 aa, Homo sapiens
ACDGERPTL

SEQ ID NO: 2479 - protein, 9 aa, Homo sapiens
AHVDKCLEL

SEQ ID NO: 2480 - protein, 10 aa, unidentified
  REGION 1..10: note = epitope involved in diabetes
ALWGPDPAAV

SEQ ID NO: 2481 - protein, 9 aa, Homo sapiens
APVIKARMM

SEQ ID NO: 2482 - protein, 10 aa, unidentified
  REGION 1..10: note = epitope involved in diabetes
AQWGPDPAAV

SEQ ID NO: 2483 - protein, 10 aa, Homo sapiens
HPRYFNQLST

SEQ ID NO: 2484 - protein, 10 aa, Homo sapiens
IPSDLERRIL

SEQ ID NO: 2485 - protein, 10 aa, unidentified
  REGION 1..10: note = epitope involved in diabetes
RQWGPDPAAV

SEQ ID NO: 2486 - protein, 9 aa, Homo sapiens
SPGSGFWSF

SEQ ID NO: 2487 - protein, 1015 aa, Homo sapiens
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 2488 - protein, 979 aa, Homo sapiens; identical to SEQ ID NO: 2028

SEQ ID NO: 2489 - protein, 11 aa, Homo sapiens
ERLGPLVEQGR

SEQ ID NO: 2490 - protein, 20 aa, Mus musculus
KCNTATCATQRALNFLVRSS

SEQ ID NO: 2491 - protein, 18 aa, Mus musculus
FAINSEMFLRSCQGENGT

SEQ ID NO: 2492 - protein, 18 aa, Mus musculus
FIKIPTHAEPLFYLLSFC

SEQ ID NO: 2493 - protein, 18 aa, Mus musculus
LTTMQLYRFIKIPTHAEP

SEQ ID NO: 2494 - protein, 18 aa, Mus musculus
TKMIWVAVIGDWFNLIFK

SEQ ID NO: 2495 - protein, 7 aa, Mycobacterium avium
GDSARVL

SEQ ID NO: 2496 - protein, 7 aa, Mycobacterium avium
HATVQID

SEQ ID NO: 2497 - protein, 7 aa, Mycobacterium avium
HLISTGD

SEQ ID NO: 2498 - protein, 9 aa, Mycobacterium avium
LAANFVVAL

SEQ ID NO: 2499 - protein, 7 aa, Mycobacterium avium
LSPGKDM

SEQ ID NO: 2500 - protein, 9 aa, Mycobacterium avium
MIAVALAGL

SEQ ID NO: 2501 - protein, 15 aa, Homo sapiens
ERTYLVNDKAAKMHA

SEQ ID NO: 2502 - protein, 15 aa, Homo sapiens
IFSILVLASTITILK

SEQ ID NO: 2503 - protein, 23 aa, Homo sapiens
KERLAALGPEGAHGDTTFEYQDL

SEQ ID NO: 2504 - protein, 14 aa, Homo sapiens
YAYAKWKLCSASAI

SEQ ID NO: 2505 - protein, 15 aa, Homo sapiens
YKIADPICTFIFSIL

SEQ ID NO: 2506 - protein, 20 aa, Mycobacterium tuberculosis
AASGPKVVIDGKDQNVTGSV

SEQ ID NO: 2507 - protein, 20 aa, Human herpesvirus
AGAGGGAGGAGAGGGAGGAG

SEQ ID NO: 2508 - protein, 21 aa, Human herpesvirus
AGAGGGAGGAGAGGGAGGAGA

SEQ ID NO: 2509 - protein, 15 aa, Mycobacterium tuberculosis
AGKPLLIIAEDVEGE

SEQ ID NO: 2510 - protein, 13 aa, Homo sapiens
AGWLADRSVRYPI

SEQ ID NO: 2511 - protein, 10 aa, Mycobacterium tuberculosis
ALSTLVVNKI

SEQ ID NO: 2512 - protein, 15 aa, Mycobacterium tuberculosis
ALSTLVVNKIRGTFK

SEQ ID NO: 2513 - protein, 20 aa, Mycobacterium tuberculosis
ASATKDGSHYKITGTATGVD

SEQ ID NO: 2514 - protein, 20 aa, Mycobacterium tuberculosis
ATGVDMANPMSPVNKSFEIE

SEQ ID NO: 2515 - protein, 10 aa, Human herpesvirus
AVFDRKSDAK

SEQ ID NO: 2516 - protein, 9 aa, Human herpesvirus
AYRRRWRRL

SEQ ID NO: 2517 - protein, 9 aa, Human herpesvirus
CLGGLLTMV

SEQ ID NO: 2518 - protein, 19 aa, Mycobacterium leprae
DAWREGEEFVVEFDLPGIK

SEQ ID NO: 2519 - protein, 20 aa, Mycobacterium tuberculosis
DGNPPEVKSVGLGNVNGVTL

SEQ ID NO: 2520 - protein, 16 aa, Mycobacterium tuberculosis
DLSLLGKARKVVVTKD

SEQ ID NO: 2521 - protein, 12 aa, Human herpesvirus
DSELEIKRYKNR

SEQ ID NO: 2522 - protein, 15 aa, Homo sapiens
DTQFVRFDSDAASQR

SEQ ID NO: 2523 - protein, 15 aa, Mycobacterium bovis
DVEGEALSTLVVNKI

SEQ ID NO: 2524 - protein, 15 aa, Mycobacterium tuberculosis
EESNTFGLQLELTEG

SEQ ID NO: 2525 - protein, 9 aa, Human herpesvirus
ELKRKMIYM

SEQ ID NO: 2526 - protein, 15 aa, Homo sapiens
ENPVVHFFKNIVTPR

SEQ ID NO: 2527 - protein, 11 aa, Human herpesvirus
EPLPQGQLTAY

SEQ ID NO: 2528 - protein, 6 aa, Proteus mirabilis
ESRRAL

SEQ ID NO: 2529 - protein, 16 aa, Homo sapiens
FDQKIVEWDSRKSKYF

SEQ ID NO: 2530 - protein, 9 aa, Human herpesvirus
FLRGRAYGL

SEQ ID NO: 2531 - protein, 18 aa, Homo sapiens
FPKPPSYNVATTLPSYDE

SEQ ID NO: 2532 - protein, 20 aa, Human herpesvirus
GAGGGAGGAGAGGGAGGAGA

SEQ ID NO: 2533 - protein, 24 aa, Human herpesvirus
GGDNHGRGRGRGRGRGGGRPGAPG

SEQ ID NO: 2534 - protein, 24 aa, Human herpesvirus
GGDNHGRGRGRGRGRGGGRPGAPG

SEQ ID NO: 2535 - protein, 24 aa, Human herpesvirus
GGDNHGRGRGRGRGRGGGRPGAPG

SEQ ID NO: 2536 - protein, 24 aa, Human herpesvirus
GGDNHGRGRGRGRGRGGGRPGAPG

SEQ ID NO: 2537 - protein, 15 aa, Phaseolus vulgaris
GGYGDGGAHGGGYGG

SEQ ID NO: 2538 - protein, 9 aa, Human herpesvirus
GLCTLVAML

SEQ ID NO: 2539 - protein, 10 aa, Mycobacterium tuberculosis
GLEPGVVAEK

SEQ ID NO: 2540 - protein, 11 aa, Mycobacterium tuberculosis
GLEPGVVAEKV

SEQ ID NO: 2541 - protein, 16 aa, Mycobacterium leprae
GMEPGVVAEKVRNLSV

SEQ ID NO: 2542 - protein, 15 aa, Mycobacterium tuberculosis
IAFNSGLEPGVVAEK

SEQ ID NO: 2543 - protein, 16 aa, Mycobacterium leprae
IAFNSGMEPGVVAEKV

SEQ ID NO: 2544 - protein, 20 aa, Mycobacterium tuberculosis
IAIGGAATGIAAVLTDGNPP

SEQ ID NO: 2545 - protein, 15 aa, Homo sapiens
KDLLEQKRAAVDTYC

SEQ ID NO: 2546 - protein, 14 aa, Human herpesvirus
KGGWFGKHRGQGGS

SEQ ID NO: 2547 - protein, 22 aa, Artemia franciscana
KKEEKKEESEEEDEDMGFGLFD

SEQ ID NO: 2548 - protein, 9 aa, Human herpesvirus
KRKMIYMCY

SEQ ID NO: 2549 - protein, 9 aa, Human herpesvirus
KRPPIFIRR

SEQ ID NO: 2550 - protein, 9 aa, Human herpesvirus
LLWTLVVLL

SEQ ID NO: 2551 - protein, 15 aa, Mycobacterium tuberculosis
MAKTIAYDEEARRGL

SEQ ID NO: 2552 - protein, 15 aa, Mycobacterium tuberculosis
MSPVNKSFEIEVTCS

SEQ ID NO: 2553 - protein, 9 aa, Human herpesvirus
NLVPMVATV

SEQ ID NO: 2554 - protein, 13 aa, Influenza A virus
PKYVKQNTLKLAT

SEQ ID NO: 2555 - protein, 13 aa, unidentified
  REGION 1..13: note = epitope involved in rheumatoid arthritis
PKYVKRNTLKLAT

SEQ ID NO: 2556 - protein, 12 aa, Clostridium tetani
PLYKKMEAVKLR

SEQ ID NO: 2557 - protein, 15 aa, Mycobacterium sp.
PYILLVSSKVSTVKD

SEQ ID NO: 2558 - protein, 16 aa, Homo sapiens
QPHDLGKVGEVIVTKD

SEQ ID NO: 2559 - protein, 8 aa, Human herpesvirus
RAKFKQLL

SEQ ID NO: 2560 - protein, 14 aa, Human herpesvirus
RARGRGRGRGEKRP

SEQ ID NO: 2561 - protein, 15 aa, Human herpesvirus
RRGRGRERARGGSRE

SEQ ID NO: 2562 - protein, 9 aa, Human herpesvirus
RRIEEICMK

SEQ ID NO: 2563 - protein, 9 aa, Human herpesvirus
RRLVVTLQC

SEQ ID NO: 2564 - protein, 9 aa, Human herpesvirus
SENDRLRLL

SEQ ID NO: 2565 - protein, 20 aa, Mycobacterium tuberculosis
SGETTTAAGTTASPGAASGP

SEQ ID NO: 2566 - protein, 13 aa, Influenza A virus
SGPLKAEIAQRLE

SEQ ID NO: 2567 - protein, 7 aa, Mus musculus
SLAYGLR

SEQ ID NO: 2568 - protein, 16 aa, Mycobacterium tuberculosis
SVAVKAPGFGDRRKAM

SEQ ID NO: 2569 - protein, 9 aa, Human herpesvirus
SVRDRLARL

SEQ ID NO: 2570 - protein, 9 aa, unidentified
  REGION 1..9: note = epitope involved in rheumatoid arthritis
TFGAQLELT

SEQ ID NO: 2571 - protein, 9 aa, Mycobacterium tuberculosis
TFGLQLELT

SEQ ID NO: 2572 - protein, 15 aa, Human T-cell lymphotrophic virus
TNSHVPILQERPPLE

SEQ ID NO: 2573 - protein, 20 aa, Mycobacterium tuberculosis
VAGLSGCSSNKSTTGSGETT

SEQ ID NO: 2574 - protein, 17 aa, Homo sapiens
VDDTQFVRFDSDAASQR

SEQ ID NO: 2575 - protein, 19 aa, Homo sapiens
VDDTQFVRFDSDAASQRME

SEQ ID NO: 2576 - protein, 20 aa, Homo sapiens
VDDTQFVRFDSDAASQRMEP

SEQ ID NO: 2577 - protein, 21 aa, Homo sapiens
VDDTQFVRFDSDAASQRMEPR

SEQ ID NO: 2578 - protein, 20 aa, Mycobacterium tuberculosis
VTGSVVCTTAAGNVNIAIGG

SEQ ID NO: 2579 - protein, 15 aa, Mycobacterium bovis
VVAEKVRNLPAGHGL

SEQ ID NO: 2580 - protein, 9 aa, Human herpesvirus
YVLDHLIVV

SEQ ID NO: 2581 - protein, 20 aa, Homo sapiens
KFGADARALMLQGVDLLADA

SEQ ID NO: 2582 - protein, 22 aa, Human herpesvirus
GGAGAGGGAGGAGAGGGAGGAG

SEQ ID NO: 2583 - protein, 11 aa, Homo sapiens
GLKGEQGEPGA

SEQ ID NO: 2584 - protein, 11 aa, Gallus gallus
IAGFKGEQGPK

SEQ ID NO: 2585 - protein, 20 aa, Mycobacterium tuberculosis
MKRGLTVAVAGAAILVAGLS

SEQ ID NO: 2586 - protein, 20 aa, Mycobacterium tuberculosis
NGVTLGYTSGTCQGNASATK

SEQ ID NO: 2587 - protein, 26 aa, Gallus gallus
PTGPLGPKGQTGELGIAGFKGEQGPK

SEQ ID NO: 2588 - protein, 9 aa, unidentified
  REGION 1..9: note = epitope involved in rheumatoid arthritis
ADGGAQGTA

SEQ ID NO: 2589 - protein, 12 aa, unidentified
  REGION 1..12: note = epitope involved in rheumatoid arthritis
ADIWLTPDPTTP

SEQ ID NO: 2590 - protein, 15 aa, Homo sapiens
CVDTRSGNCYLDIRP

SEQ ID NO: 2591 - protein, 12 aa, unidentified
  REGION 1..12: note = epitope involved in rheumatoid arthritis
DVYWLMPDPPTS

SEQ ID NO: 2592 - protein, 15 aa, Homo sapiens
EPVSGSFTTALDGPS

SEQ ID NO: 2593 - protein, 15 aa, Homo sapiens
FFYFFTGSSQLEFDP

SEQ ID NO: 2594 - protein, 15 aa, Rattus norvegicus
GIAGFKGEQGPKGET

SEQ ID NO: 2595 - protein, 21 aa, Homo sapiens
GPKGQTGEPGIAGFKGEQGPK

SEQ ID NO: 2596 - protein, 21 aa, Homo sapiens
GPKGQTGKPGIAGFKGEQGPK

SEQ ID NO: 2597 - protein, 12 aa, unidentified
  REGION 1..12: note = epitope involved in rheumatoid arthritis
GTSTEVWLAPDP

SEQ ID NO: 2598 - protein, 15 aa, Homo sapiens
GVVSHSFPATLETQE

SEQ ID NO: 2599 - protein, 12 aa, unidentified
  REGION 1..12: note = epitope involved in rheumatoid arthritis
HLPSFLRPDPPL

SEQ ID NO: 2600 - protein, 12 aa, unidentified
  REGION 1..12: note = epitope involved in rheumatoid arthritis
IFPSFLRPDPPL

SEQ ID NO: 2601 - protein, 15 aa, Homo sapiens
ISGLPSGGDDLETST

SEQ ID NO: 2602 - protein, 15 aa, Homo sapiens
IWYINCFGCETHAML

SEQ ID NO: 2603 - protein, 15 aa, Homo sapiens
LSGLPSGGEVLEISV

SEQ ID NO: 2604 - protein, 9 aa, unidentified
  REGION 1..9: note = epitope involved in rheumatoid arthritis
LSSREPQAR

SEQ ID NO: 2605 - protein, 11 aa, Rattus norvegicus
LVGPRGERGFP

SEQ ID NO: 2606 - protein, 17 aa, Homo sapiens
NEEGFFSARGHRPLDKK

SEQ ID NO: 2607 - protein, 12 aa, unidentified
  REGION 1..12: note = epitope involved in rheumatoid arthritis
NSDHFLQPDPPL

SEQ ID NO: 2608 - protein, 9 aa, unidentified
  REGION 1..9: note = epitope involved in rheumatoid arthritis
PGPSRAHFL

SEQ ID NO: 2609 - protein, 15 aa, Escherichia coli
QKRAAYDQYGHAAFE

SEQ ID NO: 2610 - protein, 9 aa, unidentified
  REGION 1..9: note = epitope involved in rheumatoid arthritis
RLTRELYAQ

SEQ ID NO: 2611 - protein, 13 aa, Homo sapiens
RSFTLASSETGVG

SEQ ID NO: 2612 - protein, 15 aa, Homo sapiens
VKEGHSPPDDVDIVI

SEQ ID NO: 2613 - protein, 16 aa, Homo sapiens
VYATRSSAVRLRSSVP

SEQ ID NO: 2614 - protein, 9 aa, unidentified
  REGION 1..9: note = epitope involved in rheumatoid arthritis
YTQKHKHQA

SEQ ID NO: 2615 - protein, 13 aa, Bos taurus
AGFKGEQGPKGEP

SEQ ID NO: 2616 - protein, 11 aa, Homo sapiens
ARGLTGRPGDA

SEQ ID NO: 2617 - protein, 15 aa, Mus musculus
ATEGQVRVNSIYQDK

SEQ ID NO: 2618 - protein, 15 aa, Bos taurus
ATYKRRLQKRSSRPL

SEQ ID NO: 2619 - protein, 21 aa, unidentified
  REGION 1..21: note = epitope involved in rheumatoid arthritis
GEPGIAGFKGDQGPKGEPGPA

SEQ ID NO: 2620 - protein, 12 aa, Rattus norvegicus
GIAGFKGEQGPK

SEQ ID NO: 2621 - protein, 15 aa, Rattus norvegicus
GIAGFKGEQGPKGET

SEQ ID NO: 2622 - protein, 8 aa, Homo sapiens
LKFVEQNE

SEQ ID NO: 2623 - protein, 15 aa, Mus musculus
NTYKHRLQKRTMRPT

SEQ ID NO: 2624 - protein, 13 aa, Homo sapiens
PTFGRSFTLASSE

SEQ ID NO: 2625 - protein, 26 aa, unidentified
  REGION 1..26: note = epitope involved in rheumatoid arthritis
PTGPLGPKGQTGELGAPGNKGEQGPK

SEQ ID NO: 2626 - protein, 14 aa, Homo sapiens
SQRFSKIASNTQSR

SEQ ID NO: 2627 - protein, 15 aa, Canis lupus
STYKRRLQKRSSRAP

SEQ ID NO: 2628 - protein, 20 aa, Homo sapiens
TGEPGIAGFKGEQGPKGEPG

SEQ ID NO: 2629 - protein, 15 aa, unidentified
  REGION 1..15: note = epitope involved in rheumatoid arthritis
TTYKRRLQKRAARHP

SEQ ID NO: 2630 - protein, 9 aa, Homo sapiens
TYKRRLQKR

SEQ ID NO: 2631 - protein, 14 aa, Sus scrofa
TYKRRLQKRSSRSL

SEQ ID NO: 2632 - protein, 13 aa, Homo sapiens
VGYDDQESVKSKV

SEQ ID NO: 2633 - protein, 18 aa, Homo sapiens
AGMDMCSAGWLADRSVRY

SEQ ID NO: 2634 - protein, 7 aa, Homo sapiens
ALPAPIE

SEQ ID NO: 2635 - protein, 7 aa, Homo sapiens
APIEKTI

SEQ ID NO: 2636 - protein, 7 aa, Homo sapiens
CKVSNKA

SEQ ID NO: 2637 - protein, 7 aa, Homo sapiens
DGKEYKC

SEQ ID NO: 2638 - protein, 7 aa, Homo sapiens
DVSHEDP

SEQ ID NO: 2639 - protein, 7 aa, Homo sapiens
EDPQVKF

SEQ ID NO: 2640 - protein, 7 aa, Homo sapiens
EKTISKA

SEQ ID NO: 2641 - protein, 6 aa, Homo sapiens
EQRRAA

SEQ ID NO: 2642 - protein, 7 aa, Homo sapiens
EYKCKVS

SEQ ID NO: 2643 - protein, 7 aa, Homo sapiens
FLFPPKP

SEQ ID NO: 2644 - protein, 7 aa, Homo sapiens
FNWYVDG

SEQ ID NO: 2645 - protein, 7 aa, Homo sapiens
FPPKPKD

SEQ ID NO: 2646 - protein, 16 aa, Bos taurus
GARGPEGAQGPRGEPG

SEQ ID NO: 2647 - protein, 15 aa, Bos taurus
GEPGIAGFKGEQGPK

SEQ ID NO: 2648 - protein, 15 aa, Rattus norvegicus
GEPGIAGFKGEQGPK

SEQ ID NO: 2649 - protein, 15 aa, Rattus norvegicus
GEPGIAGFKGEQGPK

SEQ ID NO: 2650 - protein, 7 aa, Homo sapiens
GKEYKCK

SEQ ID NO: 2651 - protein, 16 aa, Homo sapiens
GKPGIAGFKGEQGPKG

SEQ ID NO: 2652 - protein, 16 aa, Homo sapiens
GNQWVGYDDQESVKSK

SEQ ID NO: 2653 - protein, 7 aa, Homo sapiens
GPSVFLF

SEQ ID NO: 2654 - protein, 11 aa, Homo sapiens
GRGDSVVYGLR

SEQ ID NO: 2655 - protein, 16 aa, Homo sapiens
GRSFTLASSETGVGAP

SEQ ID NO: 2656 - protein, 15 aa, Homo sapiens
GTSLTIPCYFIDPMH

SEQ ID NO: 2657 - protein, 7 aa, Homo sapiens
GVQVHNA

SEQ ID NO: 2658 - protein, 7 aa, Homo sapiens
HQNWLDG

SEQ ID NO: 2659 - protein, 7 aa, Homo sapiens
IEKTISK

SEQ ID NO: 2660 - protein, 7 aa, Homo sapiens
ISKAKGQ

SEQ ID NO: 2661 - protein, 7 aa, Homo sapiens
KALPAPI

SEQ ID NO: 2662 - protein, 7 aa, Homo sapiens
KCKVSNK

SEQ ID NO: 2663 - protein, 7 aa, Homo sapiens
KEYKCKV

SEQ ID NO: 2664 - protein, 7 aa, Homo sapiens
KFNWYVD

SEQ ID NO: 2665 - protein, 15 aa, Gallus gallus
KGQTGELGIAGFKGE

SEQ ID NO: 2666 - protein, 7 aa, Homo sapiens
KPREQQY

SEQ ID NO: 2667 - protein, 7 aa, Homo sapiens
KTISKAK

SEQ ID NO: 2668 - protein, 7 aa, Homo sapiens
KTKPREQ

SEQ ID NO: 2669 - protein, 7 aa, Homo sapiens
KVSNKAL

SEQ ID NO: 2670 - protein, 7 aa, Homo sapiens
LDGKEYK

SEQ ID NO: 2671 - protein, 7 aa, Homo sapiens
LFPPKPK

SEQ ID NO: 2672 - protein, 33 aa, Homo sapiens
LGPKGQTGEPGIAGFKGEQGPKGEPGPAGPQGA

SEQ ID NO: 2673 - protein, 7 aa, Homo sapiens
LHQNWLD

SEQ ID NO: 2674 - protein, 7 aa, Homo sapiens
LPAPIEK

SEQ ID NO: 2675 - protein, 7 aa, Homo sapiens
LTVLHQN

SEQ ID NO: 2676 - protein, 16 aa, Homo sapiens
MGIPTFGRSFTLASSE

SEQ ID NO: 2677 - protein, 7 aa, Homo sapiens
NAKTKPR

SEQ ID NO: 2678 - protein, 16 aa, Homo sapiens
NFGSQRFSKIASNTQS

SEQ ID NO: 2679 - protein, 7 aa, Homo sapiens
NKALPAP

SEQ ID NO: 2680 - protein, 7 aa, Homo sapiens
NSTYRVV

SEQ ID NO: 2681 - protein, 7 aa, Homo sapiens
NWLDGKE

SEQ ID NO: 2682 - protein, 7 aa, Homo sapiens
NWYVDGV

SEQ ID NO: 2683 - protein, 7 aa, Homo sapiens
PAPIEKT

SEQ ID NO: 2684 - protein, 7 aa, Homo sapiens
PIEKTIS

SEQ ID NO: 2685 - protein, 7 aa, Homo sapiens
PQVKFNW

SEQ ID NO: 2686 - protein, 7 aa, Homo sapiens
PREQQYN

SEQ ID NO: 2687 - protein, 7 aa, Homo sapiens
PSVFLFP

SEQ ID NO: 2688 - protein, 16 aa, Homo sapiens
QHLDFISIMTYDFHGA

SEQ ID NO: 2689 - protein, 7 aa, Homo sapiens
QNWLDGK

SEQ ID NO: 2690 - protein, 7 aa, Homo sapiens
QQYNSTY

SEQ ID NO: 2691 - protein, 7 aa, Homo sapiens
QVKFNWY

SEQ ID NO: 2692 - protein, 16 aa, Homo sapiens
QWVGYDDQESVKSKVQ

SEQ ID NO: 2693 - protein, 7 aa, Homo sapiens
QYNSTYR

SEQ ID NO: 2694 - protein, 7 aa, Homo sapiens
REQQYNS

SEQ ID NO: 2695 - protein, 7 aa, Homo sapiens
RVVSVLT

SEQ ID NO: 2696 - protein, 16 aa, Homo sapiens
SCFPDALDRFLCTHII

SEQ ID NO: 2697 - protein, 7 aa, Homo sapiens
SNKALPA

SEQ ID NO: 2698 - protein, 7 aa, Homo sapiens
SVFLFPP

SEQ ID NO: 2699 - protein, 7 aa, Homo sapiens
SVLTVLH

SEQ ID NO: 2700 - protein, 7 aa, Homo sapiens
TISKAKG

SEQ ID NO: 2701 - protein, 7 aa, Homo sapiens
TVLHQNW

SEQ ID NO: 2702 - protein, 7 aa, Homo sapiens
TYRVVSV

SEQ ID NO: 2703 - protein, 7 aa, Homo sapiens
VDGVQVH

SEQ ID NO: 2704 - protein, 7 aa, Homo sapiens
VFLFPPK

SEQ ID NO: 2705 - protein, 7 aa, Homo sapiens
VHNAKTK

SEQ ID NO: 2706 - protein, 7 aa, Homo sapiens
VKFNWYV

SEQ ID NO: 2707 - protein, 7 aa, Homo sapiens
VLHQNWL

SEQ ID NO: 2708 - protein, 7 aa, Homo sapiens
VSNKALP

SEQ ID NO: 2709 - protein, 7 aa, Homo sapiens
VSVLTVL

SEQ ID NO: 2710 - protein, 18 aa, Homo sapiens
VVLLVATEGRVRVNSAYQ

SEQ ID NO: 2711 - protein, 7 aa, Homo sapiens
VVSVLTV

SEQ ID NO: 2712 - protein, 18 aa, Homo sapiens
VVVKGIVFHYRAISTRYT

SEQ ID NO: 2713 - protein, 7 aa, Homo sapiens
WLDGKEY

SEQ ID NO: 2714 - protein, 7 aa, Homo sapiens
WYVDGVQ

SEQ ID NO: 2715 - protein, 7 aa, Homo sapiens
YKCKVSN

SEQ ID NO: 2716 - protein, 15 aa, Homo sapiens
YLAWQAGMDMCSAGW

SEQ ID NO: 2717 - protein, 7 aa, Homo sapiens
YNSTYRV

SEQ ID NO: 2718 - protein, 7 aa, Homo sapiens
YRVVSVL

SEQ ID NO: 2719 - protein, 7 aa, Homo sapiens
YVDGVQV

SEQ ID NO: 2720 - protein, 9 aa, Human herpesvirus
AARQRLQDI

SEQ ID NO: 2721 - protein, 13 aa, Homo sapiens
AGWLADGSLRYPI

SEQ ID NO: 2722 - protein, 13 aa, Homo sapiens
AGWLADQTVRYPI

SEQ ID NO: 2723 - protein, 14 aa, Homo sapiens
ARGAQGPPGATGFP

SEQ ID NO: 2724 - protein, 18 aa, Homo sapiens
ATLEVQSLRSNDSGVYRC

SEQ ID NO: 2725 - protein, 10 aa, unidentified
  REGION 1..10: note = epitope involved in rheumatoid arthritis
AWNCCVKQTP

SEQ ID NO: 2726 - protein, 20 aa, Mycobacterium tuberculosis
AYDEEARRGLERGLNALADA

SEQ ID NO: 2727 - protein, 9 aa, Human herpesvirus
CLGGLLTMN

SEQ ID NO: 2728 - protein, 7 aa, Homo sapiens
CSVMHEG

SEQ ID NO: 2729 - protein, 11 aa, Homo sapiens
DAGPQGKVGPS

SEQ ID NO: 2730 - protein, 7 aa, Homo sapiens
DGSFFLY

SEQ ID NO: 2731 - protein, 18 aa, Homo sapiens
DSGHRGYSGSQASDNEGH

SEQ ID NO: 2732 - protein, 9 aa, Porphyromonas gingivalis
DSRGNPTVE

SEQ ID NO: 2733 - protein, 7 aa, Homo sapiens
EGLHNHY

SEQ ID NO: 2734 - protein, 11 aa, Homo sapiens
ERGLKGHRGFT

SEQ ID NO: 2735 - protein, 11 aa, Homo sapiens
GGQGSRHQQAR

SEQ ID NO: 2736 - protein, 14 aa, Homo sapiens
GGVGPIGPPGERGA

SEQ ID NO: 2737 - protein, 9 aa, Bos taurus
GPAGPAGER

SEQ ID NO: 2738 - protein, 9 aa, Human herpesvirus
GPKVKRPPI

SEQ ID NO: 2739 - protein, 11 aa, unidentified
  REGION 1..11: note = epitope involved in rheumatoid arthritis
GWVAMHPQGDL

SEQ ID NO: 2740 - protein, 21 aa, Homo sapiens
HQCHQESTRGRSRGRCGRSGS

SEQ ID NO: 2741 - protein, 18 aa, Homo sapiens
HSASQDGQDTIRGHPGSS

SEQ ID NO: 2742 - protein, 22 aa, Homo sapiens
HSGIGHGQASSAVRDSGHRGYS

SEQ ID NO: 2743 - protein, 17 aa, Homo sapiens
HSTSQEGQDTIHGHRGS

SEQ ID NO: 2744 - protein, 7 aa, Homo sapiens
KSLSLSP

SEQ ID NO: 2745 - protein, 20 aa, Homo sapiens
LGLRLIYFSYDVKMKEKGDI

SEQ ID NO: 2746 - protein, 10 aa, unidentified
  REGION 1..10: note = epitope involved in rheumatoid arthritis
LGWMRYHPQA

SEQ ID NO: 2747 - protein, 10 aa, Human herpesvirus
LLDFVRFMGY

SEQ ID NO: 2748 - protein, 10 aa, unidentified
  REGION 1..10: note = epitope involved in rheumatoid arthritis
LLPWLDGHPM

SEQ ID NO: 2749 - protein, 10 aa, Homo sapiens
LLRGYHQDAY

SEQ ID NO: 2750 - protein, 11 aa, Homo sapiens
LVGPRGERGFP

SEQ ID NO: 2751 - protein, 10 aa, unidentified
  REGION 1..10: note = epitope involved in rheumatoid arthritis
NWLSLITAAR

SEQ ID NO: 2752 - protein, 13 aa, Homo sapiens
PEFSGLPSGIAEV

SEQ ID NO: 2753 - protein, 15 aa, Mus musculus
PPGANGNPGPAGPPG

SEQ ID NO: 2754 - protein, 9 aa, Homo sapiens
PPGPTGASG

SEQ ID NO: 2755 - protein, 7 aa, Homo sapiens
PQVYTLP

SEQ ID NO: 2756 - protein, 7 aa, Homo sapiens
PREPQVY

SEQ ID NO: 2757 - protein, 11 aa, Homo sapiens
QGKVGPSGAPG

SEQ ID NO: 2758 - protein, 9 aa, Human herpesvirus
QLLQHYREV

SEQ ID NO: 2759 - protein, 18 aa, Homo sapiens
RGFTGLQGLPGPPGPSGD

SEQ ID NO: 2760 - protein, 9 aa, unidentified
  REGION 1..9: note = epitope involved in rheumatoid arthritis
RRLPFGSQM

SEQ ID NO: 2761 - protein, 15 aa, Homo sapiens
RVAEQLRAYLEGECV

SEQ ID NO: 2762 - protein, 19 aa, Homo sapiens
SGFQGLPGPPGPPGEGGGK

SEQ ID NO: 2763 - protein, 19 aa, Homo sapiens
SHQESTRGRSRGRSGRSGS

SEQ ID NO: 2764 - protein, 10 aa, unidentified
  REGION 1..10: note = epitope involved in rheumatoid arthritis
SIFFAVVLEL

SEQ ID NO: 2765 - protein, 10 aa, unidentified
  REGION 1..10: note = epitope involved in rheumatoid arthritis
SLCINLRAAR

SEQ ID NO: 2766 - protein, 11 aa, unidentified
  REGION 1..11: note = epitope involved in rheumatoid arthritis
SLITAARGAPS

SEQ ID NO: 2767 - protein, 17 aa, Homo sapiens
SMNVEVTDKGDVPEGYK

SEQ ID NO: 2768 - protein, 17 aa, Homo sapiens
SQIVNDFQKGDIAEGYS

SEQ ID NO: 2769 - protein, 10 aa, unidentified
  REGION 1..10: note = epitope involved in rheumatoid arthritis
VDLMTIRSCR

SEQ ID NO: 2770 - protein, 9 aa, Human herpesvirus
VMATLLPPV

SEQ ID NO: 2771 - protein, 13 aa, Homo sapiens
WDRETQICKAKAQ

SEQ ID NO: 2772 - protein, 10 aa, unidentified
  REGION 1..10: note = epitope involved in rheumatoid arthritis
WFTSWERDWW

SEQ ID NO: 2773 - protein, 10 aa, unidentified
  REGION 1..10: note = epitope involved in rheumatoid arthritis
WPPSFWYHPQ

SEQ ID NO: 2774 - protein, 10 aa, unidentified
  REGION 1..10: note = epitope involved in rheumatoid arthritis
WVAMHPQGDL

SEQ ID NO: 2775 - protein, 10 aa, unidentified
  REGION 1..10: note = epitope involved in rheumatoid arthritis
WWATFFEATR

SEQ ID NO: 2776 - protein, 10 aa, unidentified
  REGION 1..10: note = epitope involved in rheumatoid arthritis
WWNMFQMGVV

SEQ ID NO: 2777 - protein, 9 aa, unidentified
  REGION 1..9: note = epitope involved in rheumatoid arthritis
AAFSELPLG

SEQ ID NO: 2778 - protein, 9 aa, unidentified
  REGION 1..9: note = epitope involved in rheumatoid arthritis
ADASVPVMP

SEQ ID NO: 2779 - protein, 15 aa, Bos taurus
AGFKGEQGPKGEPGP

SEQ ID NO: 2780 - protein, 18 aa, Homo sapiens
AGFKGEQGPKGEPGPAGP

SEQ ID NO: 2781 - protein, 18 aa, Homo sapiens
AGFKGEQGPKGEPGPAGP

SEQ ID NO: 2782 - protein, 9 aa, unidentified
  REGION 1..9: note = epitope involved in rheumatoid arthritis
AKYSNQRAQ

SEQ ID NO: 2783 - protein, 9 aa, unidentified
  REGION 1..9: note = epitope involved in rheumatoid arthritis
ALARLMPGS

SEQ ID NO: 2784 - protein, 9 aa, unidentified
  REGION 1..9: note = epitope involved in rheumatoid arthritis
APRRLFDIA

SEQ ID NO: 2785 - protein, 9 aa, unidentified
  REGION 1..9: note = epitope involved in rheumatoid arthritis
APSSLAGNG

SEQ ID NO: 2786 - protein, 9 aa, unidentified
  REGION 1..9: note = epitope involved in rheumatoid arthritis
AQAYDLSPS

SEQ ID NO: 2787 - protein, 9 aa, unidentified
  REGION 1..9: note = epitope involved in rheumatoid arthritis
AQSAITACW

SEQ ID NO: 2788 - protein, 9 aa, unidentified
  REGION 1..9: note = epitope involved in rheumatoid arthritis
ASKAKARPV

SEQ ID NO: 2789 - protein, 9 aa, unidentified
  REGION 1..9: note = epitope involved in rheumatoid arthritis
ATADYPQKS

SEQ ID NO: 2790 - protein, 9 aa, unidentified
  REGION 1..9: note = epitope involved in rheumatoid arthritis
ATNIFIEGT

SEQ ID NO: 2791 - protein, 9 aa, unidentified
  REGION 1..9: note = epitope involved in rheumatoid arthritis
CTRHPDCQA

SEQ ID NO: 2792 - protein, 16 aa, Homo sapiens
DDTQFVRFDSDAASPR

SEQ ID NO: 2793 - protein, 16 aa, Homo sapiens
DLRSWTAADTAAQITQ

SEQ ID NO: 2794 - protein, 17 aa, Homo sapiens
DLSSWTAADTAAQITQR

SEQ ID NO: 2795 - protein, 15 aa, Homo sapiens
DNPEYSPDPSIYAYD

SEQ ID NO: 2796 - protein, 18 aa, Bos taurus
EPGIAGFKGEQGPKGEPG

SEQ ID NO: 2797 - protein, 9 aa, unidentified
  REGION 1..9: note = epitope involved in rheumatoid arthritis
EQAQSQTLP

SEQ ID NO: 2798 - protein, 9 aa, unidentified
  REGION 1..9: note = epitope involved in rheumatoid arthritis
EVAHPSVPL

SEQ ID NO: 2799 - protein, 15 aa, Homo sapiens
FEDMAKSDKARYDRE

SEQ ID NO: 2800 - protein, 17 aa, Homo sapiens
FLAEGGGVRGPRVVERH

SEQ ID NO: 2801 - protein, 12 aa, Homo sapiens
FVRFDSDAASPR

SEQ ID NO: 2802 - protein, 11 aa, Homo sapiens
FVRFDSDAASQ

SEQ ID NO: 2803 - protein, 13 aa, Homo sapiens
FVRFDSDAASQRM

SEQ ID NO: 2804 - protein, 9 aa, unidentified
  REGION 1..9: note = epitope involved in rheumatoid arthritis
GASGDIAKQ

SEQ ID NO: 2805 - protein, 9 aa, unidentified
  REGION 1..9: note = epitope involved in rheumatoid arthritis
GGETLLHMA

SEQ ID NO: 2806 - protein, 15 aa, Homo sapiens
GIAGFKGEQGPKGEP

SEQ ID NO: 2807 - protein, 15 aa, Homo sapiens
GIAGFKGEQGPKGEP

SEQ ID NO: 2808 - protein, 15 aa, Rattus norvegicus
GIAGFKGEQGPKGET

SEQ ID NO: 2809 - protein, 15 aa, Bos taurus
GPEGAQGPRGEPGTP

SEQ ID NO: 2810 - protein, 9 aa, unidentified
  REGION 1..9: note = epitope involved in rheumatoid arthritis
GPPRRLIDT

SEQ ID NO: 2811 - protein, 9 aa, unidentified
  REGION 1..9: note = epitope involved in rheumatoid arthritis
GRTPEDNTL

SEQ ID NO: 2812 - protein, 9 aa, unidentified
  REGION 1..9: note = epitope involved in rheumatoid arthritis
GWPVAPDPA

SEQ ID NO: 2813 - protein, 9 aa, unidentified
  REGION 1..9: note = epitope involved in rheumatoid arthritis
HAKKTPPAS

SEQ ID NO: 2814 - protein, 9 aa, unidentified
  REGION 1..9: note = epitope involved in rheumatoid arthritis
HELGDIAIA

SEQ ID NO: 2815 - protein, 9 aa, unidentified
  REGION 1..9: note = epitope involved in rheumatoid arthritis
HLRQGRNTA

SEQ ID NO: 2816 - protein, 21 aa, unidentified
  REGION 1..21: note = epitope involved in rheumatoid arthritis
HQCHQESTRGRSRGRCGRSGS

SEQ ID NO: 2817 - protein, 9 aa, unidentified
  REGION 1..9: note = epitope involved in rheumatoid arthritis
IRRSETPRA

SEQ ID NO: 2818 - protein, 9 aa, unidentified
  REGION 1..9: note = epitope involved in rheumatoid arthritis
IRYHTNWSS

SEQ ID NO: 2819 - protein, 19 aa, Homo sapiens
IYFRNQKGHSGLQPTGFLS

SEQ ID NO: 2820 - protein, 19 aa, Homo sapiens
IYFRNQKGHSGLQPTGLLS

SEQ ID NO: 2821 - protein, 15 aa, Homo sapiens
KEKSKFEDMAKSDKA

SEQ ID NO: 2822 - protein, 15 aa, Homo sapiens
KHKVYACEVTHQGLS

SEQ ID NO: 2823 - protein, 16 aa, Homo sapiens
KIHAREIFDSRGNPTV

SEQ ID NO: 2824 - protein, 15 aa, Homo sapiens
KKGKKKDPNAPKRPP

SEQ ID NO: 2825 - protein, 9 aa, unidentified
  REGION 1..9: note = epitope involved in rheumatoid arthritis
KMPIEADPL

SEQ ID NO: 2826 - protein, 15 aa, Homo sapiens
KSDKARYDREMKNYV

SEQ ID NO: 2827 - protein, 9 aa, unidentified
  REGION 1..9: note = epitope involved in rheumatoid arthritis
KSGPIDIIG

SEQ ID NO: 2828 - protein, 15 aa, Homo sapiens
KTMSAKEKSKFEDMA

SEQ ID NO: 2829 - protein, 9 aa, unidentified
  REGION 1..9: note = epitope involved in rheumatoid arthritis
LGLHALQSP

SEQ ID NO: 2830 - protein, 9 aa, unidentified
  REGION 1..9: note = epitope involved in rheumatoid arthritis
LGRDANAWK

SEQ ID NO: 2831 - protein, 9 aa, unidentified
  REGION 1..9: note = epitope involved in rheumatoid arthritis
LLRPVARDT

SEQ ID NO: 2832 - protein, 9 aa, unidentified
  REGION 1..9: note = epitope involved in rheumatoid arthritis
LNTAKHRES

SEQ ID NO: 2833 - protein, 13 aa, Homo sapiens
LPSYEEALSLPSK

SEQ ID NO: 2834 - protein, 9 aa, unidentified
  REGION 1..9: note = epitope involved in rheumatoid arthritis
LSRASLKTL

SEQ ID NO: 2835 - protein, 15 aa, Homo sapiens
LSSWTAADTAAQITQ

SEQ ID NO: 2836 - protein, 9 aa, unidentified
  REGION 1..9: note = epitope involved in rheumatoid arthritis
LVGTPQKTK

SEQ ID NO: 2837 - protein, 15 aa, Homo sapiens
MKNYVPPKGDKKGKK

SEQ ID NO: 2838 - protein, 9 aa, unidentified
  REGION 1..9: note = epitope involved in rheumatoid arthritis
NKALTFFLP

SEQ ID NO: 2839 - protein, 9 aa, unidentified
  REGION 1..9: note = epitope involved in rheumatoid arthritis
NLFTQTGTP

SEQ ID NO: 2840 - protein, 9 aa, unidentified
  REGION 1..9: note = epitope involved in rheumatoid arthritis
NNSFEKVKQ

SEQ ID NO: 2841 - protein, 9 aa, unidentified
  REGION 1..9: note = epitope involved in rheumatoid arthritis
NSSPYLNTK

SEQ ID NO: 2842 - protein, 9 aa, unidentified
  REGION 1..9: note = epitope involved in rheumatoid arthritis
PDHLPRHVS

SEQ ID NO: 2843 - protein, 9 aa, unidentified
  REGION 1..9: note = epitope involved in rheumatoid arthritis
PEIIENFDP

SEQ ID NO: 2844 - protein, 9 aa, unidentified
  REGION 1..9: note = epitope involved in rheumatoid arthritis
PLTNRRLRG

SEQ ID NO: 2845 - protein, 15 aa, Homo sapiens
PPKGDKKGKKKDPNA

SEQ ID NO: 2846 - protein, 9 aa, unidentified
  REGION 1..9: note = epitope involved in rheumatoid arthritis
PPLLLTDVT

SEQ ID NO: 2847 - protein, 9 aa, unidentified
  REGION 1..9: note = epitope involved in rheumatoid arthritis
PQSPGSSFP

SEQ ID NO: 2848 - protein, 9 aa, unidentified
  REGION 1..9: note = epitope involved in rheumatoid arthritis
PSFPPALRL

SEQ ID NO: 2849 - protein, 9 aa, unidentified
  REGION 1..9: note = epitope involved in rheumatoid arthritis
PVSSTRGNM

SEQ ID NO: 2850 - protein, 9 aa, unidentified
  REGION 1..9: note = epitope involved in rheumatoid arthritis
PYPFAQKRL

SEQ ID NO: 2851 - protein, 9 aa, unidentified
  REGION 1..9: note = epitope involved in rheumatoid arthritis
QSPRLYPGS

SEQ ID NO: 2852 - protein, 9 aa, unidentified
  REGION 1..9: note = epitope involved in rheumatoid arthritis
RGGIRRQSL

SEQ ID NO: 2853 - protein, 9 aa, unidentified
  REGION 1..9: note = epitope involved in rheumatoid arthritis
RKALRLSAS

SEQ ID NO: 2854 - protein, 9 aa, unidentified
  REGION 1..9: note = epitope involved in rheumatoid arthritis
RPPHSASWR

SEQ ID NO: 2855 - protein, 9 aa, unidentified
  REGION 1..9: note = epitope involved in rheumatoid arthritis
RRGPEAHQA

SEQ ID NO: 2856 - protein, 9 aa, unidentified
  REGION 1..9: note = epitope involved in rheumatoid arthritis
RRRVRNSDT

SEQ ID NO: 2857 - protein, 15 aa, Homo sapiens
RYDREMKNYVPPKGD

SEQ ID NO: 2858 - protein, 9 aa, unidentified
  REGION 1..9: note = epitope involved in rheumatoid arthritis
SESTIQNLR

SEQ ID NO: 2859 - protein, 14 aa, Homo sapiens
SHQESTRGRSRGRS

SEQ ID NO: 2860 - protein, 19 aa, Homo sapiens
SHQESTRGRSRGRSGRSGS

SEQ ID NO: 2861 - protein, 19 aa, Homo sapiens
SHQESTRGRSRGRSGRSGS

SEQ ID NO: 2862 - protein, 19 aa, Homo sapiens
SHQESTRGRSRGRSGRSGS

SEQ ID NO: 2863 - protein, 19 aa, Homo sapiens
SHQESTRGRSRGRSGRSGS

SEQ ID NO: 2864 - protein, 19 aa, Homo sapiens
SHQESTRGRSRGRSGRSGS

SEQ ID NO: 2865 - protein, 19 aa, Homo sapiens
SHQESTRGRSRGRSGRSGS

SEQ ID NO: 2866 - protein, 19 aa, Homo sapiens
SHQESTRGRSRGRSGRSGS

SEQ ID NO: 2867 - protein, 19 aa, Homo sapiens
SHQESTRGRSRGRSGRSGS

SEQ ID NO: 2868 - protein, 9 aa, unidentified
  REGION 1..9: note = epitope involved in rheumatoid arthritis
STLVPNKAP

SEQ ID NO: 2869 - protein, 16 aa, Homo sapiens
STRSVSSSSYRRMFGG

SEQ ID NO: 2870 - protein, 9 aa, unidentified
  REGION 1..9: note = epitope involved in rheumatoid arthritis
TFRDLHQQQ

SEQ ID NO: 2871 - protein, 14 aa, Homo sapiens
TGPSTRGRQGSRHE

SEQ ID NO: 2872 - protein, 17 aa, Homo sapiens
TGPSTRGRQGSRHEQAQ

SEQ ID NO: 2873 - protein, 17 aa, Homo sapiens
TGPSTRGRQGSRHEQAQ

SEQ ID NO: 2874 - protein, 18 aa, Homo sapiens
TIHAHPGSRRGGRHGYHH

SEQ ID NO: 2875 - protein, 10 aa, unidentified
  REGION 1..10: note = epitope involved in rheumatoid arthritis
TLTFTLNKLR

SEQ ID NO: 2876 - protein, 9 aa, unidentified
  REGION 1..9: note = epitope involved in rheumatoid arthritis
TPDSLGRPS

SEQ ID NO: 2877 - protein, 17 aa, Homo sapiens
VDDTQFVRFDSDAASPR

SEQ ID NO: 2878 - protein, 21 aa, Homo sapiens
VDDTQFVRFDSDAASPRGEPR

SEQ ID NO: 2879 - protein, 9 aa, unidentified
  REGION 1..9: note = epitope involved in rheumatoid arthritis
VPVDAGTAK

SEQ ID NO: 2880 - protein, 9 aa, unidentified
  REGION 1..9: note = epitope involved in rheumatoid arthritis
YKLRRAYYA

SEQ ID NO: 2881 - protein, 9 aa, unidentified
  REGION 1..9: note = epitope involved in rheumatoid arthritis
YTLQKAVLS

SEQ ID NO: 2882 - protein, 11 aa, Rattus norvegicus
ARGLTGRPGDA

SEQ ID NO: 2883 - protein, 16 aa, Homo sapiens
CKPISGHNSLFWYRQT

SEQ ID NO: 2884 - protein, 16 aa, Homo sapiens
DAGVIQSPRHEVTEMG

SEQ ID NO: 2885 - protein, 7 aa, Homo sapiens
DELTKNQ

SEQ ID NO: 2886 - protein, 7 aa, Homo sapiens
DKSRWQE

SEQ ID NO: 2887 - protein, 10 aa, Homo sapiens
DPISGHVSLF

SEQ ID NO: 2888 - protein, 7 aa, Homo sapiens
DSDGSFF

SEQ ID NO: 2889 - protein, 10 aa, Homo sapiens
EALHNHYQKS

SEQ ID NO: 2890 - protein, 7 aa, Homo sapiens
EGNVFSC

SEQ ID NO: 2891 - protein, 7 aa, Homo sapiens
ENYKTTP

SEQ ID NO: 2892 - protein, 7 aa, Homo sapiens
EPQVYTL

SEQ ID NO: 2893 - protein, 7 aa, Homo sapiens
EWGSNDG

SEQ ID NO: 2894 - protein, 7 aa, Homo sapiens
FFLYSKL

SEQ ID NO: 2895 - protein, 7 aa, Homo sapiens
FLYSKLT

SEQ ID NO: 2896 - protein, 15 aa, Bos taurus
GERGSPGAVGPKGSP

SEQ ID NO: 2897 - protein, 7 aa, Homo sapiens
GLHNHYT

SEQ ID NO: 2898 - protein, 7 aa, Homo sapiens
GNVFSCS

SEQ ID NO: 2899 - protein, 15 aa, Bos taurus
GPTGARGPEGAQGPR

SEQ ID NO: 2900 - protein, 7 aa, Homo sapiens
GQPREPQ

SEQ ID NO: 2901 - protein, 15 aa, Bos taurus
GSAGAPGIAGAPGFP

SEQ ID NO: 2902 - protein, 7 aa, Homo sapiens
GSFFLYS

SEQ ID NO: 2903 - protein, 7 aa, Homo sapiens
HEGLHNH

SEQ ID NO: 2904 - protein, 8 aa, Rattus norvegicus
IAGFKGEQ

SEQ ID NO: 2905 - protein, 16 aa, Homo sapiens
KIQPSEPRDSAVYFCA

SEQ ID NO: 2906 - protein, 7 aa, Homo sapiens
KNQVSLT

SEQ ID NO: 2907 - protein, 10 aa, Homo sapiens
KPISGHNSLF

SEQ ID NO: 2908 - protein, 7 aa, Homo sapiens
KSRWQEG

SEQ ID NO: 2909 - protein, 7 aa, Homo sapiens
LDSDGSF

SEQ ID NO: 2910 - protein, 7 aa, Homo sapiens
LHNHYTQ

SEQ ID NO: 2911 - protein, 7 aa, Homo sapiens
LTKNQVS

SEQ ID NO: 2912 - protein, 11 aa, Homo sapiens
LVGPRGERGFP

SEQ ID NO: 2913 - protein, 7 aa, Homo sapiens
MHEGLHN

SEQ ID NO: 2914 - protein, 14 aa, Rattus norvegicus
MPGERGAAGIAGPK

SEQ ID NO: 2915 - protein, 7 aa, Homo sapiens
NQVSLTC

SEQ ID NO: 2916 - protein, 7 aa, Homo sapiens
NVFSCSV

SEQ ID NO: 2917 - protein, 7 aa, Homo sapiens
NYKTTPP

SEQ ID NO: 2918 - protein, 7 aa, Homo sapiens
PPSRDEL

SEQ ID NO: 2919 - protein, 7 aa, Homo sapiens
PPSREEM

SEQ ID NO: 2920 - protein, 7 aa, Homo sapiens
PSRDELT

SEQ ID NO: 2921 - protein, 7 aa, Homo sapiens
PSREEMT

SEQ ID NO: 2922 - protein, 7 aa, Homo sapiens
QKSLSLS

SEQ ID NO: 2923 - protein, 16 aa, Homo sapiens
QPLKEQPALNDSRYCL

SEQ ID NO: 2924 - protein, 7 aa, Homo sapiens
QPREPQV

SEQ ID NO: 2925 - protein, 7 aa, Homo sapiens
QVSLTCL

SEQ ID NO: 2926 - protein, 7 aa, Homo sapiens
QVYTLPP

SEQ ID NO: 2927 - protein, 7 aa, Homo sapiens
REPQVYT

SEQ ID NO: 2928 - protein, 21 aa, Mus musculus
RGFGFVTFSSMAEVDAAMAAR

SEQ ID NO: 2929 - protein, 11 aa, Homo sapiens
RSLDFQATTMF

SEQ ID NO: 2930 - protein, 7 aa, Homo sapiens
RWQEGNV

SEQ ID NO: 2931 - protein, 16 aa, Homo sapiens
SATFWQNPRNHFRCQV

SEQ ID NO: 2932 - protein, 7 aa, Homo sapiens
SCSVMHE

SEQ ID NO: 2933 - protein, 7 aa, Homo sapiens
SDGSFFL

SEQ ID NO: 2934 - protein, 7 aa, Homo sapiens
SFFLYSK

SEQ ID NO: 2935 - protein, 27 aa, Mus musculus
SGKPGAHVTVKKLFVGGIKEDTEEHHL

SEQ ID NO: 2936 - protein, 19 aa, Homo sapiens
SHQESTRGRSRGRSGRSGS

SEQ ID NO: 2937 - protein, 7 aa, Homo sapiens
SLSLSPG

SEQ ID NO: 2938 - protein, 7 aa, Homo sapiens
SLTCLVK

SEQ ID NO: 2939 - protein, 10 aa, Homo sapiens
SPRSGDLSVY

SEQ ID NO: 2940 - protein, 7 aa, Homo sapiens
SREEMTK

SEQ ID NO: 2941 - protein, 7 aa, Homo sapiens
SRWQEGN

SEQ ID NO: 2942 - protein, 16 aa, Homo sapiens
SRYCLSSRLRVSATFW

SEQ ID NO: 2943 - protein, 7 aa, Homo sapiens
SVMHEGL

SEQ ID NO: 2944 - protein, 7 aa, Homo sapiens
TKNQVSL

SEQ ID NO: 2945 - protein, 7 aa, Homo sapiens
TLPPSRE

SEQ ID NO: 2946 - protein, 7 aa, Homo sapiens
VEWGSND

SEQ ID NO: 2947 - protein, 7 aa, Homo sapiens
VFSCSVM

SEQ ID NO: 2948 - protein, 7 aa, Homo sapiens
VMHEGLH

SEQ ID NO: 2949 - protein, 7 aa, Homo sapiens
VSLTCLV

SEQ ID NO: 2950 - protein, 16 aa, Homo sapiens
VYFCASSFSTCSANYG

SEQ ID NO: 2951 - protein, 7 aa, Homo sapiens
VYTLPPS

SEQ ID NO: 2952 - protein, 7 aa, Homo sapiens
WQEGNVF

SEQ ID NO: 2953 - protein, 15 aa, Homo sapiens
GIAGAPGFPGPRGPP

SEQ ID NO: 2954 - protein, 15 aa, Homo sapiens
GIPGAKGSAGAPGIA

SEQ ID NO: 2955 - protein, 20 aa, Homo sapiens
ARGHRPLDKKREEAPSLRPA

SEQ ID NO: 2956 - protein, 20 aa, Homo sapiens
ARGHRPLDKKREEAPSLRPA

SEQ ID NO: 2957 - protein, 20 aa, Homo sapiens
ARGHRPLDKKREEAPSLRPA

SEQ ID NO: 2958 - protein, 20 aa, Homo sapiens
ARGHRPLDKKREEAPSLRPA

SEQ ID NO: 2959 - protein, 20 aa, Homo sapiens
ARGHRPLDKKREEAPSLRPA

SEQ ID NO: 2960 - protein, 20 aa, Homo sapiens
ARGHRPLDKKREEAPSLRPA

SEQ ID NO: 2961 - protein, 20 aa, Homo sapiens
ARGHRPLDKKREEAPSLRPA

SEQ ID NO: 2962 - protein, 20 aa, Homo sapiens
ARGHRPLDKKREEAPSLRPA

SEQ ID NO: 2963 - protein, 20 aa, Homo sapiens
ARGHRPLDKKREEAPSLRPA

SEQ ID NO: 2964 - protein, 20 aa, Homo sapiens
ARGHRPLDKKREEAPSLRPA

SEQ ID NO: 2965 - protein, 20 aa, Homo sapiens
ARGHRPLDKKREEAPSLRPA

SEQ ID NO: 2966 - protein, 20 aa, Homo sapiens
ARGHRPLDKKREEAPSLRPA

SEQ ID NO: 2967 - protein, 20 aa, Homo sapiens
ARGHRPLDKKREEAPSLRPA

SEQ ID NO: 2968 - protein, 20 aa, Homo sapiens
ARGHRPLDKKREEAPSLRPA

SEQ ID NO: 2969 - protein, 20 aa, Homo sapiens
ARGHRPLDKKREEAPSLRPA

SEQ ID NO: 2970 - protein, 20 aa, Homo sapiens
ARGHRPLDKKREEAPSLRPA

SEQ ID NO: 2971 - protein, 21 aa, unidentified
  REGION 1..21: note = epitope involved in rheumatoid arthritis
ARGHRPLDKKREEAPSLRPAD

SEQ ID NO: 2972 - protein, 38 aa, unidentified
  REGION 1..38: note = epitope involved in rheumatoid arthritis
ARGHRPLDKKREEAPSLRPAGGGHSTKRGHAKSRPVRG

SEQ ID NO: 2973 - protein, 18 aa, Homo sapiens
FFSARGHRPLDKKREEAP

SEQ ID NO: 2974 - protein, 18 aa, Homo sapiens
FFSARGHRPLDKKREEAP

SEQ ID NO: 2975 - protein, 18 aa, Homo sapiens
FFSARGHRPLDKKREEAP

SEQ ID NO: 2976 - protein, 18 aa, Homo sapiens
FFSARGHRPLDKKREEAP

SEQ ID NO: 2977 - protein, 18 aa, Homo sapiens
FFSARGHRPLDKKREEAP

SEQ ID NO: 2978 - protein, 18 aa, Homo sapiens
FFSARGHRPLDKKREEAP

SEQ ID NO: 2979 - protein, 18 aa, Homo sapiens
FFSARGHRPLDKKREEAP

SEQ ID NO: 2980 - protein, 18 aa, Homo sapiens
FFSARGHRPLDKKREEAP

SEQ ID NO: 2981 - protein, 24 aa, unidentified
  REGION 1..24: note = epitope involved in rheumatoid arthritis
GFFCARGHRPLDKKREEAPCLRPA

SEQ ID NO: 2982 - protein, 18 aa, Homo sapiens
GNVSPGTRREYHTEKLVT

SEQ ID NO: 2983 - protein, 18 aa, Homo sapiens
GNVSPGTRREYHTEKLVT

SEQ ID NO: 2984 - protein, 18 aa, Homo sapiens
GNVSPGTRREYHTEKLVT

SEQ ID NO: 2985 - protein, 21 aa, unidentified [sequence omitted]

SEQ ID NO: 2986 - protein, 15 aa, Homo sapiens
HSTKRGHAKSRPVRG

SEQ ID NO: 2987 - protein, 15 aa, Homo sapiens
HSTKRGHAKSRPVRG

SEQ ID NO: 2988 - protein, 15 aa, Homo sapiens
HSTKRGHAKSRPVRG

SEQ ID NO: 2989 - protein, 15 aa, Homo sapiens
HSTKRGHAKSRPVRG

SEQ ID NO: 2990 - protein, 15 aa, Homo sapiens
HSTKRGHAKSRPVRG

SEQ ID NO: 2991 - protein, 15 aa, Homo sapiens
HSTKRGHAKSRPVRG

SEQ ID NO: 2992 - protein, 15 aa, Homo sapiens
HSTKRGHAKSRPVRG

SEQ ID NO: 2993 - protein, 15 aa, Homo sapiens
HSTKRGHAKSRPVRG

SEQ ID NO: 2994 - protein, 36 aa, unidentified
  REGION 1..36: note = epitope involved in rheumatoid arthritis
HSTKRGHAKSRPVRGHQCHQESTRGRSRGRCGRSGS

SEQ ID NO: 2995 - protein, 18 aa, Homo sapiens
IAKDLLPSRDRQHLPLIK

SEQ ID NO: 2996 - protein, 18 aa, Homo sapiens
IAKDLLPSRDRQHLPLIK

SEQ ID NO: 2997 - protein, 18 aa, Homo sapiens
IAKDLLPSRDRQHLPLIK

SEQ ID NO: 2998 - protein, 18 aa, Homo sapiens
IAKDLLPSRDRQHLPLIK

SEQ ID NO: 2999 - protein, 22 aa, Mus musculus
QTLDHNTMYWYKQDSKKLLKIM

SEQ ID NO: 3000 - protein, 18 aa, Homo sapiens
RARPAKAAATQKKVERKA

SEQ ID NO: 3001 - protein, 18 aa, Homo sapiens
RARPAKAAATQKKVERKA

SEQ ID NO: 3002 - protein, 18 aa, Homo sapiens
RARPAKAAATQKKVERKA

SEQ ID NO: 3003 - protein, 18 aa, Homo sapiens
RARPAKAAATQKKVERKA

SEQ ID NO: 3004 - protein, 18 aa, Homo sapiens
RARPAKAAATQKKVERKA

SEQ ID NO: 3005 - protein, 18 aa, Homo sapiens
RARPAKAAATQKKVERKA

SEQ ID NO: 3006 - protein, 18 aa, Homo sapiens
SGIGTLDGFRHRHPDEAA

SEQ ID NO: 3007 - protein, 18 aa, Homo sapiens
SGIGTLDGFRHRHPDEAA

SEQ ID NO: 3008 - protein, 18 aa, Homo sapiens
SRALAREVDLKDYEDQQK

SEQ ID NO: 3009 - protein, 18 aa, Homo sapiens
SRALAREVDLKDYEDQQK

SEQ ID NO: 3010 - protein, 18 aa, Homo sapiens
SRALAREVDLKDYEDQQK

SEQ ID NO: 3011 - protein, 15 aa, Homo sapiens
GNPGTDGIPGAKGSA

SEQ ID NO: 3012 - protein, 15 aa, Homo sapiens
GPAGASGNPGTDGIP

SEQ ID NO: 3013 - protein, 15 aa, Homo sapiens
GPRGEPGTPGSPGPA

SEQ ID NO: 3014 - protein, 15 aa, Homo sapiens
GTPGSPGPAGASGNP

SEQ ID NO: 3015 - protein, 7 aa, Homo sapiens
AGEKVTM

SEQ ID NO: 3016 - protein, 7 aa, Homo sapiens
AHIWWND

SEQ ID NO: 3017 - protein, 7 aa, Homo sapiens
ARMRDGA

SEQ ID NO: 3018 - protein, 7 aa, Homo sapiens
ASTRESG

SEQ ID NO: 3019 - protein, 7 aa, Homo sapiens
AVYFCHQ

SEQ ID NO: 3020 - protein, 7 aa, Homo sapiens
AWFAYWG

SEQ ID NO: 3021 - protein, 7 aa, Homo sapiens
AYWGQGT

SEQ ID NO: 3022 - protein, 7 aa, Homo sapiens
CARMRDG

SEQ ID NO: 3023 - protein, 7 aa, Homo sapiens
CHQYLSS

SEQ ID NO: 3024 - protein, 7 aa, Homo sapiens
CSFSGFS

SEQ ID NO: 3025 - protein, 7 aa, Homo sapiens
DGAWFAY

SEQ ID NO: 3026 - protein, 7 aa, Homo sapiens
DHKNYLA

SEQ ID NO: 3027 - protein, 7 aa, Homo sapiens
DLAVYFC

SEQ ID NO: 3028 - protein, 7 aa, Homo sapiens
EDLAVYF

SEQ ID NO: 3029 - protein, 7 aa, Homo sapiens
ESGVPDR

SEQ ID NO: 3030 - protein, 7 aa, Homo sapiens
EWLAHIW

SEQ ID NO: 3031 - protein, 7 aa, Homo sapiens
FAYWGQG

SEQ ID NO: 3032 - protein, 7 aa, Homo sapiens
FCHQYLS

SEQ ID NO: 3033 - protein, 7 aa, Homo sapiens
FSGFSLT

SEQ ID NO: 3034 - protein, 7 aa, Homo sapiens
FSLTTYG

SEQ ID NO: 3035 - protein, 7 aa, Homo sapiens
FYNTVLK

SEQ ID NO: 3036 - protein, 7 aa, Homo sapiens
GAWFAYW

SEQ ID NO: 3037 - protein, 7 aa, Homo sapiens
GFSLTTY

SEQ ID NO: 3038 - protein, 7 aa, Homo sapiens
GIGVGWI

SEQ ID NO: 3039 - protein, 7 aa, Homo sapiens
GKGLEWL

SEQ ID NO: 3040 - protein, 7 aa, Homo sapiens
GLEWLAH

SEQ ID NO: 3041 - protein, 15 aa, Bos taurus
GPAGPAGTAGARGAP

SEQ ID NO: 3042 - protein, 7 aa, Homo sapiens
GQSPKLL

SEQ ID NO: 3043 - protein, 7 aa, Homo sapiens
GSGSGTD

SEQ ID NO: 3044 - protein, 7 aa, Homo sapiens
GSGTDFT

SEQ ID NO: 3045 - protein, 7 aa, Homo sapiens
GVGWIRQ

SEQ ID NO: 3046 - protein, 7 aa, Homo sapiens
GVPDRFT

SEQ ID NO: 3047 - protein, 7 aa, Homo sapiens
GWIRQRS

SEQ ID NO: 3048 - protein, 7 aa, Homo sapiens
HIWWNDN

SEQ ID NO: 3049 - protein, 7 aa, Homo sapiens
HQYLSSF

SEQ ID NO: 3050 - protein, 7 aa, Homo sapiens
IGVGWIR

SEQ ID NO: 3051 - protein, 7 aa, Homo sapiens
IRQRSGK

SEQ ID NO: 3052 - protein, 7 aa, Homo sapiens
IWWNDNK

SEQ ID NO: 3053 - protein, 7 aa, Homo sapiens
KGLEWLA

SEQ ID NO: 3054 - protein, 7 aa, Homo sapiens
KLLIYWA

SEQ ID NO: 3055 - protein, 7 aa, Homo sapiens
KNYLAWY

SEQ ID NO: 3056 - protein, 7 aa, Homo sapiens
KVTMTCK

SEQ ID NO: 3057 - protein, 7 aa, Homo sapiens
LAHIWWN

SEQ ID NO: 3058 - protein, 7 aa, Homo sapiens
LAVYFCH

SEQ ID NO: 3059 - protein, 7 aa, Homo sapiens
LEWLAHI

SEQ ID NO: 3060 - protein, 7 aa, Homo sapiens
LIYWAST

SEQ ID NO: 3061 - protein, 7 aa, Homo sapiens
LLIYWAS

SEQ ID NO: 3062 - protein, 7 aa, Homo sapiens
LTCSFSG

SEQ ID NO: 3063 - protein, 7 aa, Homo sapiens
LYSSDHK

SEQ ID NO: 3064 - protein, 7 aa, Homo sapiens
MRDGAWF

SEQ ID NO: 3065 - protein, 7 aa, Homo sapiens
NYLAWYQ

SEQ ID NO: 3066 - protein, 7 aa, Homo sapiens
PGQSPKL

SEQ ID NO: 3067 - protein, 7 aa, Homo sapiens
PKLLIYW

SEQ ID NO: 3068 - protein, 7 aa, Homo sapiens
QSPKLLI

SEQ ID NO: 3069 - protein, 7 aa, Homo sapiens
QSVLYSS

SEQ ID NO: 3070 - protein, 7 aa, Homo sapiens
QTEDLAV

SEQ ID NO: 3071 - protein, 7 aa, Homo sapiens
QYLSSFT

SEQ ID NO: 3072 - protein, 7 aa, Homo sapiens
RDGAWFA

SEQ ID NO: 3073 - protein, 7 aa, Homo sapiens
RESGVPD

SEQ ID NO: 3074 - protein, 7 aa, Homo sapiens
RMRDGAW

SEQ ID NO: 3075 - protein, 7 aa, Homo sapiens
SAGEKVT

SEQ ID NO: 3076 - protein, 7 aa, Homo sapiens
SDHKNYL

SEQ ID NO: 3077 - protein, 7 aa, Homo sapiens
SFSGFSL

SEQ ID NO: 3078 - protein, 7 aa, Homo sapiens
SGFSLTT

SEQ ID NO: 3079 - protein, 7 aa, Homo sapiens
SGSGTDF

SEQ ID NO: 3080 - protein, 7 aa, Homo sapiens
SGVPDRF

SEQ ID NO: 3081 - protein, 7 aa, Homo sapiens
SLTTYGI

SEQ ID NO: 3082 - protein, 7 aa, Homo sapiens
SPKLLIY

SEQ ID NO: 3083 - protein, 7 aa, Homo sapiens
SQSVLYS

SEQ ID NO: 3084 - protein, 7 aa, Homo sapiens
SSQSVLY

SEQ ID NO: 3085 - protein, 7 aa, Homo sapiens
STRESGV

SEQ ID NO: 3086 - protein, 7 aa, Homo sapiens
SVLYSSD

SEQ ID NO: 3087 - protein, 7 aa, Homo sapiens
TCSFSGF

SEQ ID NO: 3088 - protein, 7 aa, Homo sapiens
TEDLAVY

SEQ ID NO: 3089 - protein, 7 aa, Homo sapiens
TGSGSGT

SEQ ID NO: 3090 - protein, 7 aa, Homo sapiens
TMTCKSS

SEQ ID NO: 3091 - protein, 7 aa, Homo sapiens
TRESGVP

SEQ ID NO: 3092 - protein, 7 aa, Homo sapiens
TTYGIGV

SEQ ID NO: 3093 - protein, 7 aa, Homo sapiens
TYGIGVG

SEQ ID NO: 3094 - protein, 7 aa, Homo sapiens
TYYCARM

SEQ ID NO: 3095 - protein, 7 aa, Homo sapiens
VGWIRQR

SEQ ID NO: 3096 - protein, 7 aa, Homo sapiens
VLYSSDH

SEQ ID NO: 3097 - protein, 7 aa, Homo sapiens
VPDRFTG

SEQ ID NO: 3098 - protein, 7 aa, Homo sapiens
VTMTCKS

SEQ ID NO: 3099 - protein, 7 aa, Homo sapiens
VYFCHQY

SEQ ID NO: 3100 - protein, 7 aa, Homo sapiens
WASTRES

SEQ ID NO: 3101 - protein, 7 aa, Homo sapiens
WFAYWGQ

SEQ ID NO: 3102 - protein, 7 aa, Homo sapiens
WIRQRSG

SEQ ID NO: 3103 - protein, 7 aa, Homo sapiens
WLAHIWW

SEQ ID NO: 3104 - protein, 7 aa, Homo sapiens
WNDNKFY

SEQ ID NO: 3105 - protein, 7 aa, Homo sapiens
WWNDNKF

SEQ ID NO: 3106 - protein, 7 aa, Homo sapiens
YCARMRD

SEQ ID NO: 3107 - protein, 7 aa, Homo sapiens
YFCHQYL

SEQ ID NO: 3108 - protein, 7 aa, Homo sapiens
YGIGVGW

SEQ ID NO: 3109 - protein, 7 aa, Homo sapiens
YLAWYQQ

SEQ ID NO: 3110 - protein, 7 aa, Homo sapiens
YLSSFTF

SEQ ID NO: 3111 - protein, 7 aa, Homo sapiens
YSSDHKN

SEQ ID NO: 3112 - protein, 7 aa, Homo sapiens
YWASTRE

SEQ ID NO: 3113 - protein, 7 aa, Homo sapiens
YYCARMR

SEQ ID NO: 3114 - protein, 16 aa, Mycobacterium tuberculosis
AILTGGQVISEEGVGL

SEQ ID NO: 3115 - protein, 16 aa, Mycobacterium tuberculosis
DRRKAMLQDMAILTGG

SEQ ID NO: 3116 - protein, 16 aa, Mycobacterium tuberculosis
DVEGEALSTLVVNKIR

SEQ ID NO: 3117 - protein, 15 aa, Mycobacterium tuberculosis
EEGVGLTLENADLSL

SEQ ID NO: 3118 - protein, 11 aa, Mycobacterium tuberculosis
VVNKIRGTFKS

SEQ ID NO: 3119 - protein, 16 aa, Mycobacterium tuberculosis
VVNKIRGTFKSVAVKA

SEQ ID NO: 3120 - protein, 13 aa, Homo sapiens
QDFTNRINKLKNS

SEQ ID NO: 3121 - protein, 8 aa, Streptococcus pyogenes
LTSRPAHG

SEQ ID NO: 3122 - protein, 12 aa, Mus musculus
LYFCAARSNYQL

SEQ ID NO: 3123 - protein, 15 aa, Rattus norvegicus
ALSTLVLNRLKVGLQ

SEQ ID NO: 3124 - protein, 15 aa, Homo sapiens
AYVLLSEKKISSIQS

SEQ ID NO: 3125 - protein, 15 aa, Homo sapiens
GEALSTLVLNRLKVG

SEQ ID NO: 3126 - protein, 15 aa, Mycobacterium sp.
GEALSTLVVNKIRGT

SEQ ID NO: 3127 - protein, 15 aa, Homo sapiens
KCEFQDAYVLLSEKK

SEQ ID NO: 3128 - protein, 15 aa, Homo sapiens
VASLLTTAEVVVTEI

SEQ ID NO: 3129 - protein, 15 aa, Rattus norvegicus
KERYSTLYISNAQVE

SEQ ID NO: 3130 - protein, 15 aa, Homo sapiens
AVCRTSMCSIQSAPP

SEQ ID NO: 3131 - protein, 15 aa, Mus musculus
GEPGIAGFKGDQGPK

SEQ ID NO: 3132 - protein, 15 aa, Rattus norvegicus
GEPGIAGFKGEQGPK

SEQ ID NO: 3133 - protein, 8 aa, Rattus norvegicus
IAGFKGEQ

SEQ ID NO: 3134 - protein, 15 aa, Bos taurus
GEPGIAGFKGEQGPK

SEQ ID NO: 3135 - protein, 15 aa, Bos taurus
GEPGIAGFKGEQGPK

SEQ ID NO: 3136 - protein, 26 aa, Homo sapiens
AGAARDALQGFKITQNNAMKISFAKK

SEQ ID NO: 3137 - protein, 24 aa, Homo sapiens
EPAVYFKEQFLDGDGWTSRWIESK

SEQ ID NO: 3138 - protein, 23 aa, Homo sapiens
GRGRGRGRGRGRGRGRGRGGPRR

SEQ ID NO: 3139 - protein, 17 aa, Homo sapiens
KALSVETEKLLKYLEAV

SEQ ID NO: 3140 - protein, 24 aa, Homo sapiens
KMTLKNREPVQLETLSIRGNRIRY

SEQ ID NO: 3141 - protein, 15 aa, Homo sapiens
KPKAAKPKKAAAKKK

SEQ ID NO: 3142 - protein, 11 aa, Homo sapiens
MAVPETRPNHT

SEQ ID NO: 3143 - protein, 20 aa, Homo sapiens
MKLVRFLMKLSHETVTIELK

SEQ ID NO: 3144 - protein, 17 aa, Enterovirus A
MVTSTITEKLLKNLVKI

SEQ ID NO: 3145 - protein, 21 aa, Mus musculus
RIHMVYSKRSGKPRGYAFIEY

SEQ ID NO: 3146 - protein, 24 aa, Homo sapiens
SQFGQILDILVSRSLKMRGQAFVI

SEQ ID NO: 3147 - protein, 22 aa, Homo sapiens
TKYKQRNGWSHKDLLRLSHLKP

SEQ ID NO: 3148 - protein, 20 aa, Homo sapiens
TLHKAFKGSIFVVFDSIESA

SEQ ID NO: 3149 - protein, 37 aa, Homo sapiens
VEPKVKSKKREAVAGRGRGRGRGRGRGRGRGRGGPRR

SEQ ID NO: 3150 - protein, 15 aa, Homo sapiens
AARGRGRGMGRGNIF

SEQ ID NO: 3151 - protein, 22 aa, Homo sapiens
TKYKQRNGWSHKDLLRLSHLKP

SEQ ID NO: 3152 - protein, 22 aa, Homo sapiens
TKYKQRNGWSHKDLLRLSHLKP

SEQ ID NO: 3153 - protein, 25 aa, Homo sapiens
VAGRGRGRGRGRGRGRGRGRGGPRR

SEQ ID NO: 3154 - protein, 18 aa, Homo sapiens
RKGHFLLSSKSGFWTIWL

SEQ ID NO: 3155 - protein, 22 aa, Mus musculus
AGRGRGRGRGRGRGRGRGRGSL

SEQ ID NO: 3156 - protein, 16 aa, Homo sapiens
GKALCWVCAQSRKHRD

SEQ ID NO: 3157 - protein, 15 aa, Human Endogenous Retrovirus
GKTCPKEIPKGSKNT

SEQ ID NO: 3158 - protein, 16 aa, Homo sapiens
GLKKMLRTCAVHITLD

SEQ ID NO: 3159 - protein, 49 aa, Mus musculus
PLFPAGRGRGRGRGRGRGRGRGRGRGRGRGRGRGRGRGRGRGRGSLIYI

SEQ ID NO: 3160 - protein, 9 aa, Mycobacterium bovis
KPLLIIAED

SEQ ID NO: 3161 - protein, 10 aa, Human adenovirus
FWRFLWGSSQ

SEQ ID NO: 3162 - protein, 20 aa, unidentified
  REGION 1..20: note = epitope involved in rheumatoid arthritis
MSKTEWNASQLPRLGGKEDR

SEQ ID NO: 3163 - protein, 20 aa, unidentified
  REGION 1..20: note = epitope involved in rheumatoid arthritis
MSKTEWNASQSRFGWFENKE

SEQ ID NO: 3164 - protein, 11 aa, Influenza A virus
TLQRFAWGSSN

SEQ ID NO: 3165 - protein, 50 aa, Homo sapiens
GYGKINKKRIALTDNALIARSLGKYGIICMEDLIHEIYTVGKRFKEANNF

SEQ ID NO: 3166 - protein, 19 aa, Homo sapiens
RMARMARKAGNFYVPAEPK

SEQ ID NO: 3167 - protein, 15 aa, Homo sapiens
AAVGTSAAPVPSDNH

SEQ ID NO: 3168 - protein, 15 aa, Proteus mirabilis
FAESRIRRETIAAED

SEQ ID NO: 3169 - protein, 15 aa, Homo sapiens
GSLDSLRREIEQMRR

SEQ ID NO: 3170 - protein, 15 aa, Proteus mirabilis
LGSSESRRALQDSQR

SEQ ID NO: 3171 - protein, 5 aa, Homo sapiens
LRREI

SEQ ID NO: 3172 - protein, 16 aa, Homo sapiens
SQKDLLEQRRAAVDTY

SEQ ID NO: 3173 - protein, 21 aa, Bos taurus
ARTKQTARKSTGGKAPRKQLA

SEQ ID NO: 3174 - protein, 15 aa, Homo sapiens
EGNRPTNSIVFTKLT

SEQ ID NO: 3175 - protein, 15 aa, Homo sapiens
FNGEKINYTEGRAVL

SEQ ID NO: 3176 - protein, 15 aa, Homo sapiens
KIFVQGIIWDINSFD

SEQ ID NO: 3177 - protein, 21 aa, Bos taurus
LAGNAARDNKKTRIIPRHLQL

SEQ ID NO: 3178 - protein, 15 aa, Homo sapiens
LGKQLAKKIEPELDG

SEQ ID NO: 3179 - protein, 15 aa, Homo sapiens
MRMLVDLAKSRGVEA

SEQ ID NO: 3180 - protein, 16 aa, Bos taurus
PATGGVKKPHRYRPGT

SEQ ID NO: 3181 - protein, 13 aa, Homo sapiens
VEIRAEGNSRFTY

SEQ ID NO: 3182 - protein, 10 aa, Homo sapiens
ASAARLTMMW

SEQ ID NO: 3183 - protein, 16 aa, Homo sapiens
LFKPPKYHPDVPYVKR

SEQ ID NO: 3184 - protein, 15 aa, Homo sapiens
LRKFKNISYFPGKLR

SEQ ID NO: 3185 - protein, 17 aa, Homo sapiens
SKLIKIFQDHPLQKTYN

SEQ ID NO: 3186 - protein, 15 aa, Proteus mirabilis
ASRETKELRQEERQP

SEQ ID NO: 3187 - protein, 15 aa, unidentified
  REGION 1..15: note = epitope involved in rheumatoid arthritis
NGSSESRRALQDSQR

SEQ ID NO: 3188 - protein, 16 aa, Rattus norvegicus
YYVFFEEQEDEIIGFG

SEQ ID NO: 3189 - protein, 15 aa, Human herpesvirus
QKRAAQRAAGPSVAS

SEQ ID NO: 3190 - protein, 15 aa, Lactococcus lactis
QKRAAYDQYGEAGAN

SEQ ID NO: 3191 - protein, 15 aa, Brucella ovis
QKRAAYDRFGHAAFE

SEQ ID NO: 3192 - protein, 19 aa, Homo sapiens
LPNFSSLNLRETNLDSLPL

SEQ ID NO: 3193 - protein, 19 aa, Homo sapiens
LPNFSSLNLRETNLDSLPL

SEQ ID NO: 3194 - protein, 19 aa, Homo sapiens
SSRSYVTTSTRTYSLGSAL

SEQ ID NO: 3195 - protein, 7 aa, unidentified
  REGION 1..7: note = epitope involved in rheumatoid arthritis
ALPPPYM

SEQ ID NO: 3196 - protein, 7 aa, unidentified
  REGION 1..7: note = epitope involved in rheumatoid arthritis
ESMPALS

SEQ ID NO: 3197 - protein, 7 aa, unidentified
  REGION 1..7: note = epitope involved in rheumatoid arthritis
GTNTAQK

SEQ ID NO: 3198 - protein, 7 aa, unidentified
  REGION 1..7: note = epitope involved in rheumatoid arthritis
IPNSTHT

SEQ ID NO: 3199 - protein, 7 aa, unidentified
  REGION 1..7: note = epitope involved in rheumatoid arthritis
KWSFTPP

SEQ ID NO: 3200 - protein, 7 aa, unidentified
  REGION 1..7: note = epitope involved in rheumatoid arthritis
LHSDARD

SEQ ID NO: 3201 - protein, 7 aa, unidentified
  REGION 1..7: note = epitope involved in rheumatoid arthritis
LNTTLKV

SEQ ID NO: 3202 - protein, 7 aa, unidentified
  REGION 1..7: note = epitope involved in rheumatoid arthritis
LPYKLTQ

SEQ ID NO: 3203 - protein, 7 aa, unidentified
  REGION 1..7: note = epitope involved in rheumatoid arthritis
MVPELTE

SEQ ID NO: 3204 - protein, 7 aa, unidentified
  REGION 1..7: note = epitope involved in rheumatoid arthritis
PGPSTTS

SEQ ID NO: 3205 - protein, 16 aa, Homo sapiens
AAAGYDVEKNNSRIKL

SEQ ID NO: 3206 - protein, 16 aa, Homo sapiens
AAKPKTAKPKAAKPKK

SEQ ID NO: 3207 - protein, 16 aa, Homo sapiens
AGAAKRKASGPPVSEL

SEQ ID NO: 3208 - protein, 16 aa, Homo sapiens
AKKAGAAKAKKPAGAA

SEQ ID NO: 3209 - protein, 16 aa, Homo sapiens
APKSPAKAKAVKPKAA

SEQ ID NO: 3210 - protein, 16 aa, Homo sapiens
ATPKKSAKKTPKKAKK

SEQ ID NO: 3211 - protein, 16 aa, Homo sapiens
EKTPVKKKARKSAGAA

SEQ ID NO: 3212 - protein, 16 aa, Homo sapiens
IKLGLKSLVSKGTLVQ

SEQ ID NO: 3213 - protein, 15 aa, unidentified
  REGION 1..15: note = epitope involved in rheumatoid arthritis
IWYINCFACETHAML

SEQ ID NO: 3214 - protein, 15 aa, unidentified
  REGION 1..15: note = epitope involved in rheumatoid arthritis
IWYINCFVCETHAML

SEQ ID NO: 3215 - protein, 15 aa, unidentified
  REGION 1..15: note = epitope involved in rheumatoid arthritis
IWYISCFGCETHAML

SEQ ID NO: 3216 - protein, 15 aa, unidentified
  REGION 1..15: note = epitope involved in rheumatoid arthritis
IWYITCFGCETHAML

SEQ ID NO: 3217 - protein, 16 aa, Homo sapiens
KAKKPAAAAGAKKAKS

SEQ ID NO: 3218 - protein, 17 aa, Homo sapiens
KEIKKVATPKKASKPKK

SEQ ID NO: 3219 - protein, 16 aa, Homo sapiens
KLNKKAASGEAKPKAK

SEQ ID NO: 3220 - protein, 16 aa, Homo sapiens
KSPKKAKAAKPKKAPK

SEQ ID NO: 3221 - protein, 15 aa, Gallus gallus
KSRKASKAKKVKRSK

SEQ ID NO: 3222 - protein, 16 aa, Homo sapiens
LVQTKGTGASGSFKLN

SEQ ID NO: 3223 - protein, 16 aa, Homo sapiens
PAGAAKKPKKATGAAT

SEQ ID NO: 3224 - protein, 16 aa, Homo sapiens
RSGVSLAALKKALAAA

SEQ ID NO: 3225 - protein, 16 aa, Homo sapiens
SETAPAAPAAPAPAEK

SEQ ID NO: 3226 - protein, 16 aa, Gallus gallus
SKPRAKSGARKSPKKK

SEQ ID NO: 3227 - protein, 31 aa, Gallus gallus
TESLVLSPAPAKPKRVKASRRSASHPTYSEM

SEQ ID NO: 3228 - protein, 16 aa, Homo sapiens
VSELITKAVAASKERS

SEQ ID NO: 3229 - protein, 18 aa, Homo sapiens
CSAGWLADRSVRYPISKA

SEQ ID NO: 3230 - protein, 16 aa, Homo sapiens
IPCYFIDPMHPVTTAP

SEQ ID NO: 3231 - protein, 16 aa, Homo sapiens
KEKEVVLLVATEGRVR

SEQ ID NO: 3232 - protein, 18 aa, Homo sapiens
LADRSVRYPISKARPNCG

SEQ ID NO: 3233 - protein, 16 aa, Homo sapiens
LQKRSSRHPRRSRPST

SEQ ID NO: 3234 - protein, 18 aa, Homo sapiens
QAGMDMCSAGWLADRSVR

SEQ ID NO: 3235 - protein, 15 aa, Yersinia enterocolitica
QKQLGWQAGMDEART

SEQ ID NO: 3236 - protein, 16 aa, Homo sapiens
QPSPLRVLLGTSLTIP

SEQ ID NO: 3237 - protein, 16 aa, Homo sapiens
RVLLGTSLTIPCYFID

SEQ ID NO: 3238 - protein, 16 aa, Homo sapiens
RVNSAYQDKVSLPNYP

SEQ ID NO: 3239 - protein, 18 aa, Homo sapiens
TTGHVYLAWQAGMDMCSA

SEQ ID NO: 3240 - protein, 17 aa, Homo sapiens
VATEGRVRVNSAYQDKV

SEQ ID NO: 3241 - protein, 9 aa, unidentified
  REGION 1..9: note = epitope involved in rheumatoid arthritis
ASSLLASSP

SEQ ID NO: 3242 - protein, 9 aa, unidentified
  REGION 1..9: note = epitope involved in rheumatoid arthritis
IPFPTLFAP

SEQ ID NO: 3243 - protein, 9 aa, unidentified
  REGION 1..9: note = epitope involved in rheumatoid arthritis
PHESDATVR

SEQ ID NO: 3244 - protein, 9 aa, unidentified
  REGION 1..9: note = epitope involved in rheumatoid arthritis
PHNRQESPA

SEQ ID NO: 3245 - protein, 9 aa, unidentified
  REGION 1..9: note = epitope involved in rheumatoid arthritis
PPLKPVIDE

SEQ ID NO: 3246 - protein, 9 aa, unidentified
  REGION 1..9: note = epitope involved in rheumatoid arthritis
PSPSLSHPL

SEQ ID NO: 3247 - protein, 16 aa, Homo sapiens
KATLVCLISDFYPGAV

SEQ ID NO: 3248 - protein, 16 aa, Homo sapiens
SGLQAEDEADYYCSSY

SEQ ID NO: 3249 - protein, 16 aa, Homo sapiens
TGTSSDVGGYNYVSWY

SEQ ID NO: 3250 - protein, 8 aa, Homo sapiens
EVFISAPR

SEQ ID NO: 3251 - protein, 21 aa, Human T-cell lymphotropic virus
PPPPSSPTHDPPDSDPQIPPP

SEQ ID NO: 3252 - protein, 8 aa, Homo sapiens
PQIVPEPM

SEQ ID NO: 3253 - protein, 21 aa, Homo sapiens
PTRAPSGPRPPSRSQAQTPPR

SEQ ID NO: 3254 - protein, 12 aa, Homo sapiens
ATEGRVRVNSAY

SEQ ID NO: 3255 - protein, 6 aa, Homo sapiens
LTSRPA

SEQ ID NO: 3256 - protein, 20 aa, Homo sapiens
VVLLVATEGRVRVNSAYQDK

SEQ ID NO: 3257 - protein, 20 aa, Homo sapiens
VVLLVATEGRVRVNSAYQDK

SEQ ID NO: 3258 - protein, 18 aa, unidentified
  REGION 1..18: note = epitope involved in rheumatoid arthritis
GPPGARGLTGRPGDAGPP

SEQ ID NO: 3259 - protein, 18 aa, unidentified
  REGION 1..18: note = epitope involved in rheumatoid arthritis
GPPGARGLTGRPGDAGPP

SEQ ID NO: 3260 - protein, 37 aa, unidentified
  REGION 1..37: note = epitope involved in rheumatoid arthritis
GPPGPPGPPGPPGPPGARGLTGRPGDAGPPGPPGACA

SEQ ID NO: 3261 - protein, 206 aa, Homo sapiens
PSVFLFPPKPKDTLMISRTPEVTCVVVDVSQEDPQVQFNWYVDGVQVHNAKTKPREQQFNSTYRVVSVLTVLHQNWLDGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSL

SEQ ID NO: 3262 - protein, 9 aa, Burkholderia fungorum
RAGTDEGFG

SEQ ID NO: 3263 - protein, 20 aa, Homo sapiens
AFFPNMVNMLVLGKHLGIPK

SEQ ID NO: 3264 - protein, 17 aa, Homo sapiens
AKYNQLLRIEEELGSKA

SEQ ID NO: 3265 - protein, 18 aa, Homo sapiens
ANGWGVMVSHRSGETEDT

SEQ ID NO: 3266 - protein, 20 aa, Homo sapiens
APDRKGFRLLLASPRSCYKL

SEQ ID NO: 3267 - protein, 20 aa, Homo sapiens
CLEEKVCSLLEPLGLQCTFI

SEQ ID NO: 3268 - protein, 18 aa, Homo sapiens
EKGVPLYRHIADLAGNSE

SEQ ID NO: 3269 - protein, 20 aa, Homo sapiens
EPLGLQCTFINDFFTYHIRH

SEQ ID NO: 3270 - protein, 13 aa, Homo sapiens
ETTEESLRNYYEQ

SEQ ID NO: 3271 - protein, 14 aa, Homo sapiens
FEEYGKIDTIEIIT

SEQ ID NO: 3272 - protein, 20 aa, Homo sapiens
FPGLITLTISLLDTSNLELP

SEQ ID NO: 3273 - protein, 20 aa, Homo sapiens
FQEQQNEGHGEALLFEGIKK

SEQ ID NO: 3274 - protein, 19 aa, Homo sapiens
FRSGKYDLDFKSPDDPSRY

SEQ ID NO: 3275 - protein, 12 aa, Homo sapiens
GARGLTGRPGDA

SEQ ID NO: 3276 - protein, 12 aa, Homo sapiens
GARGLTGRPGDA

SEQ ID NO: 3277 - protein, 19 aa, Homo sapiens
IQVVGDDLTVTNPKRIAKA

SEQ ID NO: 3278 - protein, 20 aa, Homo sapiens
KAASGSTGDQKVQISYYGPK

SEQ ID NO: 3279 - protein, 13 aa, Homo sapiens
KFAGRNFRNPLAK

SEQ ID NO: 3280 - protein, 17 aa, Homo sapiens
KIHAREIFDSRGNPTVE

SEQ ID NO: 3281 - protein, 17 aa, Homo sapiens
KIHAREIFDSRGNPTVE

SEQ ID NO: 3282 - protein, 17 aa, Homo sapiens
KIHAREIFDSRGNPTVE

SEQ ID NO: 3283 - protein, 17 aa, Homo sapiens
KIHAREIFDSRGNPTVE

SEQ ID NO: 3284 - protein, 17 aa, Porphyromonas gingivalis
KIIGREILDSRGNPTVE

SEQ ID NO: 3285 - protein, 20 aa, Homo sapiens
KSVTTLAMKAKCKLTICPEE

SEQ ID NO: 3286 - protein, 20 aa, Homo sapiens
LLDTSNLELPEAVVFQDSVV

SEQ ID NO: 3287 - protein, 20 aa, Homo sapiens
LVNCDRDNLESSAMDCEDDE

SEQ ID NO: 3288 - protein, 20 aa, Homo sapiens
NDFFTYHIRHGEVHCGTNVR

SEQ ID NO: 3289 - protein, 18 aa, Homo sapiens
NFREAMRIGAEVYHNLKN

SEQ ID NO: 3290 - protein, 18 aa, Homo sapiens
NPKRIAKAVNEKSCNCLL

SEQ ID NO: 3291 - protein, 20 aa, Homo sapiens
PFGPVINGRCCLEEKVCSLL

SEQ ID NO: 3292 - protein, 20 aa, Homo sapiens
PGGKHNMDFYVEALAFPDTD

SEQ ID NO: 3293 - protein, 17 aa, Homo sapiens
RDYFEEYGKIDTIEIIT

SEQ ID NO: 3294 - protein, 20 aa, Homo sapiens
SINASPGVVVDIAHSPPAKK

SEQ ID NO: 3295 - protein, 17 aa, Homo sapiens
VDLFTSKGLFRAAVPSG

SEQ ID NO: 3296 - protein, 20 aa, Homo sapiens
VEALAFPDTDFPGLITLTIS

SEQ ID NO: 3297 - protein, 20 aa, Homo sapiens
VLDSEDLQDMSLMTLSTKTP

SEQ ID NO: 3298 - protein, 20 aa, Homo sapiens
VRVFQATRGKLSSKCSVVLG

SEQ ID NO: 3299 - protein, 20 aa, Homo sapiens
WGPCGQGAILLVNCDRDNLE

SEQ ID NO: 3300 - protein, 21 aa, Homo sapiens
YEALELRDNDKTRYMGKGVSK

SEQ ID NO: 3301 - protein, 25 aa, Homo sapiens
ACLDVGAVIATPEQLFAAYEDGFEQ

SEQ ID NO: 3302 - protein, 24 aa, Homo sapiens
DFDRAQRACLQNSAIIATPEQLQA

SEQ ID NO: 3303 - protein, 25 aa, Homo sapiens
FAAYEDGFEQCDAGWLADQTVRYPI

SEQ ID NO: 3304 - protein, 25 aa, Mus musculus
FAAYEDGFEQCDAGWLSDQTVRYPI

SEQ ID NO: 3305 - protein, 25 aa, Homo sapiens
FDQCDYGWLSDASVRHPVTVARAQC

SEQ ID NO: 3306 - protein, 25 aa, Homo sapiens
GVRTLYRFENQTGFPPPDSRFDAYC

SEQ ID NO: 3307 - protein, 24 aa, Homo sapiens
HQCDAGWLADQTVRYPIHTPREGC

SEQ ID NO: 3308 - protein, 23 aa, Mus musculus
IASPEQLFAAYEDGFEQCDAGWL

SEQ ID NO: 3309 - protein, 23 aa, Mus musculus
IATPEQLQAAYEDGFHQCDAGWL

SEQ ID NO: 3310 - protein, 24 aa, Homo sapiens
IATPEQLQAAYEDGFHQCDAGWLA

SEQ ID NO: 3311 - protein, 24 aa, Homo sapiens
LADRSVRYPISKARPNCGGNLLGV

SEQ ID NO: 3312 - protein, 25 aa, Homo sapiens
LHKVKVGKSPPVRGSLSGKVSLPCH

SEQ ID NO: 3313 - protein, 24 aa, Homo sapiens
PIHTPREGCYGDKDEFPGVRTYGI

SEQ ID NO: 3314 - protein, 25 aa, Homo sapiens
PPDSRFDAYCFKRRMSDLSVIGHPI

SEQ ID NO: 3315 - protein, 25 aa, Mus musculus
QAAYEDGFHQCDAGWLADQTVRYPI

SEQ ID NO: 3316 - protein, 25 aa, Homo sapiens
RLATVGELQAAWRNGFDQCDYGWLS

SEQ ID NO: 3317 - protein, 24 aa, Homo sapiens
RVSKEKEVVLLVATEGRVRVNSAY

SEQ ID NO: 3318 - protein, 13 aa, Homo sapiens
SDLSVIGHPIDSE

SEQ ID NO: 3319 - protein, 24 aa, Homo sapiens
YLAWQAGMDMCSAGWLADRSVRYP

SEQ ID NO: 3320 - protein, 20 aa, Mus musculus
HQCHQESTGRSRGRCGRSGS

SEQ ID NO: 3321 - protein, 21 aa, Mus musculus
HQCHQESTKGKSKGKCGKSGS

SEQ ID NO: 3322 - protein, 21 aa, Mus musculus
HQCHQESTKGKSKGKCGKSGS

SEQ ID NO: 3323 - protein, 19 aa, Mus musculus
SHQESTKGKSKGKSGKSGS

SEQ ID NO: 3324 - protein, 19 aa, Mus musculus
SHQESTKGKSKGKSGKSGS

SEQ ID NO: 3325 - protein, 7 aa, Homo sapiens
CSVMHEA

SEQ ID NO: 3326 - protein, 7 aa, unidentified
  REGION 1..7: note = epitope involved in rheumatoid arthritis
FRVVSVL

SEQ ID NO: 3327 - protein, 7 aa, unidentified
  REGION 1..7: note = epitope involved in rheumatoid arthritis
HNAKTKL

SEQ ID NO: 3328 - protein, 7 aa, Homo sapiens
MHEALHN

SEQ ID NO: 3329 - protein, 7 aa, unidentified
  REGION 1..7: note = epitope involved in rheumatoid arthritis
PREQQFN

SEQ ID NO: 3330 - protein, 7 aa, unidentified
  REGION 1..7: note = epitope involved in rheumatoid arthritis
QQFNSTF

SEQ ID NO: 3331 - protein, 7 aa, Homo sapiens
SVMHEAL

SEQ ID NO: 3332 - protein, 7 aa, unidentified
  REGION 1..7: note = epitope involved in rheumatoid arthritis
TFRVVSV

SEQ ID NO: 3333 - protein, 7 aa, Homo sapiens
VLTVLHQ

SEQ ID NO: 3334 - protein, 7 aa, Homo sapiens
VMHEALH

SEQ ID NO: 3335 - protein, 15 aa, Homo sapiens
DKKREEAPSLRPAPP

SEQ ID NO: 3336 - protein, 15 aa, Homo sapiens
DSPGSGNARPNNPDW

SEQ ID NO: 3337 - protein, 14 aa, Homo sapiens
EQSADSSRHSGSGH

SEQ ID NO: 3338 - protein, 15 aa, Homo sapiens
ERGSAGHWTSESSVS

SEQ ID NO: 3339 - protein, 14 aa, Homo sapiens
ESSRDGSRHPRSHD

SEQ ID NO: 3340 - protein, 15 aa, Homo sapiens
GDKELRTGKEKVTSG

SEQ ID NO: 3341 - protein, 15 aa, Homo sapiens
GPRVVERHQSACKDS

SEQ ID NO: 3342 - protein, 15 aa, Homo sapiens
GTFEEVSGNVSPGTR

SEQ ID NO: 3343 - protein, 15 aa, Homo sapiens
IEVLKRKVIEKVQHI

SEQ ID NO: 3344 - protein, 15 aa, Homo sapiens
LENLRSKIQKLESDV

SEQ ID NO: 3345 - protein, 15 aa, Homo sapiens
LLQQERPIRNSVDEL

SEQ ID NO: 3346 - protein, 15 aa, Homo sapiens
MELERPGGNEITRGG

SEQ ID NO: 3347 - protein, 15 aa, Homo sapiens
NRCHAANPNGRYYWG

SEQ ID NO: 3348 - protein, 15 aa, Homo sapiens
PEWKALTDMPQMRME

SEQ ID NO: 3349 - protein, 15 aa, Homo sapiens
PRKQCSKEDGGGWWY

SEQ ID NO: 3350 - protein, 15 aa, Homo sapiens
QKLESDVSAQMEYCR

SEQ ID NO: 3351 - protein, 15 aa, Homo sapiens
QNPGSPRPGSTGTWN

SEQ ID NO: 3352 - protein, 15 aa, Homo sapiens
RGHAKSRPVRGIHTS

SEQ ID NO: 3353 - protein, 15 aa, Homo sapiens
RPAPPPISGGGYRAR

SEQ ID NO: 3354 - protein, 15 aa, Homo sapiens
SCSRALAREVDLKDY

SEQ ID NO: 3355 - protein, 15 aa, Homo sapiens
SGCRMKGLIDEVNQD

SEQ ID NO: 3356 - protein, 15 aa, Homo sapiens
SGIGTLDGFRHRHPD

SEQ ID NO: 3357 - protein, 15 aa, Homo sapiens
SRGSESGIFTNTKES

SEQ ID NO: 3358 - protein, 15 aa, Homo sapiens
SSHHPGIAEFPSRGK

SEQ ID NO: 3359 - protein, 15 aa, Homo sapiens
SYNRGDSTFESKSYK

SEQ ID NO: 3360 - protein, 14 aa, Homo sapiens [sequence omitted]

SEQ ID NO: 3361 - protein, 18 aa, Homo sapiens
TIHAHPGSRRGGRHGYHH

SEQ ID NO: 3362 - protein, 15 aa, Homo sapiens
TTRRSCSKTVTKTVI

SEQ ID NO: 3363 - protein, 15 aa, Homo sapiens
VDIDIKIRSCRGSCS

SEQ ID NO: 3364 - protein, 15 aa, Homo sapiens
VIQNRQDGSVDFGRK

SEQ ID NO: 3365 - protein, 15 aa, Homo sapiens
WYNRCHAANPNGRYY

SEQ ID NO: 3366 - protein, 15 aa, Homo sapiens
WYSMRKMSMKIRPFF

SEQ ID NO: 3367 - protein, 15 aa, Homo sapiens
GGGYRARPAKAAATQ

SEQ ID NO: 3368 - protein, 15 aa, Homo sapiens
GKLYGIRDVRSTRDR

SEQ ID NO: 3369 - protein, 15 aa, Homo sapiens
YAEYHFRVGSEAEGY

SEQ ID NO: 3370 - protein, 20 aa, Porphyromonas gingivalis
TLVVNRLRGSLKICAVKAPG

SEQ ID NO: 3371 - protein, 17 aa, Homo sapiens
KIHAREIFDSRGNPTVE

SEQ ID NO: 3372 - protein, 19 aa, Homo sapiens
ANKYQISVNKYRGTAGNAL

SEQ ID NO: 3373 - protein, 30 aa, Homo sapiens
KYQISVNKYRGTAGNALMDGASQLMGENRT

SEQ ID NO: 3374 - protein, 30 aa, Homo sapiens; identical to SEQ ID NO: 3373

SEQ ID NO: 3375 - protein, 18 aa, Homo sapiens
NKYRGTAGNALMDGASQL

SEQ ID NO: 3376 - protein, 18 aa, Homo sapiens
NKYRGTAGNALMDGASQL

SEQ ID NO: 3377 - protein, 10 aa, Homo sapiens
LVVYPWTQRF

SEQ ID NO: 3378 - protein, 18 aa, Homo sapiens
QVTQPTVGMNFKTPRGPV

SEQ ID NO: 3379 - protein, 16 aa, Homo sapiens
RLPIIDVAPLDVGAPD

SEQ ID NO: 3380 - protein, 16 aa, Homo sapiens
TQGKIVDLVKELDRDT

SEQ ID NO: 3381 - protein, 9 aa, Human herpesvirus
GQSRGQSRG

SEQ ID NO: 3382 - protein, 21 aa, Human herpesvirus
GQSRGQSRGRGRGRGRGRGKG

SEQ ID NO: 3383 - protein, 15 aa, Human herpesvirus
GRGRGRGRGRGGGRG

SEQ ID NO: 3384 - protein, 8 aa, Homo sapiens
DLLPSRDR

SEQ ID NO: 3385 - protein, 8 aa, Homo sapiens
DLLPSRDR

SEQ ID NO: 3386 - protein, 9 aa, Homo sapiens
DRQHLPLIK

SEQ ID NO: 3387 - protein, 24 aa, Homo sapiens
EEAPSLRPAPPPISGGGYRARPAK

SEQ ID NO: 3388 - protein, 24 aa, Homo sapiens
EEAPSLRPAPPPISGGGYRARPAK

SEQ ID NO: 3389 - protein, 17 aa, Homo sapiens
ESSSHHPGIAEFPSRGK

SEQ ID NO: 3390 - protein, 15 aa, Homo sapiens
KDLLPSRDRQHLPLI

SEQ ID NO: 3391 - protein, 15 aa, Homo sapiens
KDLLPSRDRQHLPLI

SEQ ID NO: 3392 - protein, 17 aa, Homo sapiens
KESSSHHPGIAEFPSRG

SEQ ID NO: 3393 - protein, 18 aa, Homo sapiens
KQFTSSTSYNRGDSTFES

SEQ ID NO: 3394 - protein, 21 aa, Homo sapiens
KQFTSSTSYNRGDSTFESKSY

SEQ ID NO: 3395 - protein, 25 aa, Homo sapiens
KREEAPSLRPAPPPISGGGYRARPA

SEQ ID NO: 3396 - protein, 18 aa, Homo sapiens
QFTSSTSYNRGDSTFESK

SEQ ID NO: 3397 - protein, 13 aa, Homo sapiens
TSSTSYNRGDSTF

SEQ ID NO: 3398 - protein, 16 aa, Homo sapiens
GVYATRSSAVRLRSSV

SEQ ID NO: 3399 - protein, 16 aa, Homo sapiens
MSTRSVSSSSYRRMFG

SEQ ID NO: 3400 - protein, 20 aa, Bos taurus
MSGRGKQGGKARAKAKTRSS

SEQ ID NO: 3401 - skipped

SEQ ID NO: 3402 - protein, 38 aa, Mus musculus
KGSITSVQAIYVPADDLTDPAPATTFAHLDATTVLSRA

SEQ ID NO: 3403 - protein, 16 aa, Mus musculus
KLVIIESDLERAEERA

SEQ ID NO: 3404 - protein, 26 aa, Mus musculus
KSLQDIIAILGMDELSEEDKLTVSRA

SEQ ID NO: 3405 - protein, 18 aa, Mus musculus
RIMNVIGEPIDERGPIKT

SEQ ID NO: 3406 - protein, 16 aa, Mus musculus
RSITTIIDTFHQYSRK

SEQ ID NO: 3407 - protein, 32 aa, Mus musculus
RTTGIVLDSGDGVTHNVPIYEGYALPHAIMRL

SEQ ID NO: 3408 - protein, 16 aa, Mycobacterium tuberculosis
GLEPGVVAEKVRNLSV

SEQ ID NO: 3409 - protein, 18 aa, Homo sapiens
AFRGQYCYELDEKAVRPG

SEQ ID NO: 3410 - protein, 16 aa, Homo sapiens
AGYALAQMGRLKGPLL

SEQ ID NO: 3411 - protein, 17 aa, Homo sapiens
AISDYVFNTASLVYHEE

SEQ ID NO: 3412 - protein, 17 aa, Homo sapiens
AKNSLYLQMNSLRAEDT

SEQ ID NO: 3413 - protein, 16 aa, Homo sapiens
ALATISTLEAVRGRPF

SEQ ID NO: 3414 - protein, 13 aa, Homo sapiens
ALTNGIYPHKLVF

SEQ ID NO: 3415 - protein, 17 aa, Homo sapiens
AMKAAMALEKKLNQALL

SEQ ID NO: 3416 - protein, 16 aa, Homo sapiens
ANGVIHMLDGILLPPT

SEQ ID NO: 3417 - protein, 15 aa, Homo sapiens
ANLELINTWVAKNTN

SEQ ID NO: 3418 - protein, 14 aa, Homo sapiens
APELLFFAKRYKAA

SEQ ID NO: 3419 - protein, 15 aa, Homo sapiens
APRLLIYDASNRATG

SEQ ID NO: 3420 - protein, 15 aa, Homo sapiens
APSAILPLPGQSVER

SEQ ID NO: 3421 - protein, 16 aa, Homo sapiens
APVELILSDETLPAPE

SEQ ID NO: 3422 - protein, 15 aa, Homo sapiens
ARTQLSWLKKQLAAA

SEQ ID NO: 3423 - protein, 14 aa, Homo sapiens
ASHFEQMAAASMHR

SEQ ID NO: 3424 - protein, 16 aa, Homo sapiens
AYPRISVNNVLPVFDN

SEQ ID NO: 3425 - protein, 24 aa, Homo sapiens
DDDGTGQKQIWRIEGSNKVPVDPA

SEQ ID NO: 3426 - protein, 19 aa, Homo sapiens
DDLKTDFYKDLTSLGHNEN

SEQ ID NO: 3427 - protein, 16 aa, Homo sapiens
DEPQYLDLPSTATSVN

SEQ ID NO: 3428 - protein, 14 aa, Homo sapiens
DFNVGGYIQAVLDR

SEQ ID NO: 3429 - protein, 16 aa, Homo sapiens
DGKRIQYQLVDISQDN

SEQ ID NO: 3430 - protein, 17 aa, Homo sapiens
DGVREVFEMATRAALQA

SEQ ID NO: 3431 - protein, 15 aa, Homo sapiens
DHPTFNKITPNLAEF

SEQ ID NO: 3432 - protein, 15 aa, Homo sapiens
DHVKLVNEVTEFAKT

SEQ ID NO: 3433 - protein, 14 aa, Homo sapiens
DIRPEIHENYRING

SEQ ID NO: 3434 - protein, 15 aa, Homo sapiens
DKVLIRIMVSRSEVD

SEQ ID NO: 3435 - protein, 17 aa, Homo sapiens
EEVKLIKKMGDHLTNLH

SEQ ID NO: 3436 - protein, 16 aa, Homo sapiens
EGARNIVAAMKAHGVD

SEQ ID NO: 3437 - protein, 12 aa, Homo sapiens
EIINWLDKNQTA

SEQ ID NO: 3438 - protein, 15 aa, Homo sapiens
ENIPFTLPEVSTNKT

SEQ ID NO: 3439 - protein, 19 aa, Homo sapiens
EPHRHSIFTPETNPRAGLE

SEQ ID NO: 3440 - protein, 18 aa, Homo sapiens
EQLGEYKFQNALLVRYTK

SEQ ID NO: 3441 - protein, 14 aa, Homo sapiens
ERNLVSWESQTQPQ

SEQ ID NO: 3442 - protein, 15 aa, Homo sapiens
ERTITMHKDSTGHVG

SEQ ID NO: 3443 - protein, 11 aa, Homo sapiens
ETFLKDLPIMF

SEQ ID NO: 3444 - protein, 13 aa, Homo sapiens
ETYGEMADCCAKQ

SEQ ID NO: 3445 - protein, 12 aa, Homo sapiens
EVENAVLGKDFK

SEQ ID NO: 3446 - protein, 22 aa, Homo sapiens
FEKSKEQLTPLIKKAGTELVNF

SEQ ID NO: 3447 - protein, 14 aa, Homo sapiens
FEPFFMMIATPAPH

SEQ ID NO: 3448 - protein, 21 aa, Homo sapiens
FLEQQNKILLAELEQLKGQGK

SEQ ID NO: 3449 - protein, 9 aa, Homo sapiens
FLLFPDMEA

SEQ ID NO: 3450 - protein, 16 aa, Homo sapiens
FPGFLENQKDPLAVDK

SEQ ID NO: 3451 - protein, 17 aa, Homo sapiens
FQNALLVRYTKKVPQVS

SEQ ID NO: 3452 - protein, 17 aa, Homo sapiens
FRGQYCYELDEKAVRPG

SEQ ID NO: 3453 - protein, 17 aa, Homo sapiens
FRGQYCYELDEKAVRPG

SEQ ID NO: 3454 - protein, 12 aa, Homo sapiens
FSISPNAVSAEE

SEQ ID NO: 3455 - protein, 12 aa, Homo sapiens
FSSEESNLGANN

SEQ ID NO: 3456 - protein, 10 aa, Homo sapiens
FVELGTQPAT

SEQ ID NO: 3457 - protein, 14 aa, Homo sapiens
GAYYLKLENQSLKS

SEQ ID NO: 3458 - protein, 17 aa, Homo sapiens
GDIQQFLITGDPKAAYD

SEQ ID NO: 3459 - protein, 18 aa, Homo sapiens
GETSEMYLIQPDSSVKPY

SEQ ID NO: 3460 - protein, 15 aa, Homo sapiens
GGGYVKLFPNSLDQT

SEQ ID NO: 3461 - protein, 18 aa, Homo sapiens
GGHAIRILGWGVENGTPY

SEQ ID NO: 3462 - protein, 16 aa, Homo sapiens
GGQFLRAVAQRCPSPP

SEQ ID NO: 3463 - protein, 17 aa, Homo sapiens
GHLSFGFMQDLQQKVVY

SEQ ID NO: 3464 - protein, 16 aa, Homo sapiens
GIKSLVSKGTLVQTKG

SEQ ID NO: 3465 - protein, 16 aa, Homo sapiens
GLKSLVSKGTLVQTKG

SEQ ID NO: 3466 - protein, 14 aa, Homo sapiens
GLLWIALHGNQITS

SEQ ID NO: 3467 - protein, 15 aa, Homo sapiens
GNQFWAIRGNEVRAG

SEQ ID NO: 3468 - protein, 12 aa, Homo sapiens
GNRIAQWQSFQL

SEQ ID NO: 3469 - protein, 22 aa, Homo sapiens
GPDPSSPAFRIEDANLIPPVPD

SEQ ID NO: 3470 - protein, 19 aa, Homo sapiens
GPGIPGRFTKEAGTLAYYE

SEQ ID NO: 3471 - protein, 15 aa, Homo sapiens
GPVKVWGSIKGLTEG

SEQ ID NO: 3472 - protein, 15 aa, Homo sapiens
GQYCYELDEKAVRPG

SEQ ID NO: 3473 - protein, 17 aa, Homo sapiens
GSAGHWTSESSVSGSTG

SEQ ID NO: 3474 - protein, 16 aa, Homo sapiens
GSHSLKYFHTSVSRPG

SEQ ID NO: 3475 - protein, 18 aa, Homo sapiens
GTDVPKWISIMTERSVPH

SEQ ID NO: 3476 - protein, 18 aa, Homo sapiens
GTGENYRGNVAVTVSGHT

SEQ ID NO: 3477 - protein, 19 aa, Homo sapiens
GVDEVTIVNILTNRSNAQR

SEQ ID NO: 3478 - protein, 12 aa, Homo sapiens
GVIKVFNDMKVR

SEQ ID NO: 3479 - protein, 13 aa, Homo sapiens
GYVRDETVRAAPY

SEQ ID NO: 3480 - protein, 18 aa, Homo sapiens
HLPDNINVYATTAANPRE

SEQ ID NO: 3481 - protein, 16 aa, Homo sapiens
HNGNLIPTHTQPSYRF

SEQ ID NO: 3482 - protein, 17 aa, Homo sapiens
IGGVILFHETLYQKADD

SEQ ID NO: 3483 - protein, 14 aa, Homo sapiens
IKIISKIENHEGVR

SEQ ID NO: 3484 - protein, 14 aa, Homo sapiens
ILEWAAERGPITSA

SEQ ID NO: 3485 - protein, 17 aa, Homo sapiens
IQSTYDQDHTVPAYVPR

SEQ ID NO: 3486 - protein, 12 aa, Homo sapiens
ISTPEELGLDKV

SEQ ID NO: 3487 - protein, 16 aa, Homo sapiens
IVHRYMTITSERSVPA

SEQ ID NO: 3488 - protein, 11 aa, Homo sapiens
IYVFHTLGQYF

SEQ ID NO: 3489 - protein, 15 aa, Homo sapiens
KIGRFVIEEVPGELM

SEQ ID NO: 3490 - protein, 24 aa, Homo sapiens
KKVPQVSTPTLVEVSRNLGKVGSK

SEQ ID NO: 3491 - protein, 14 aa, Homo sapiens
KPQYMVLVPSLLHT

SEQ ID NO: 3492 - protein, 16 aa, Homo sapiens
KTGKLVSLSAQNLVDC

SEQ ID NO: 3493 - protein, 14 aa, Homo sapiens
LAEFAFSLYRQLAH

SEQ ID NO: 3494 - protein, 14 aa, Homo sapiens
LAVVKSIRSIPAYL

SEQ ID NO: 3495 - protein, 15 aa, Homo sapiens
LDDPKYSSDEDLPSK

SEQ ID NO: 3496 - protein, 15 aa, Homo sapiens
LDFLKAVDTNRASVG

SEQ ID NO: 3497 - protein, 12 aa, Homo sapiens
LGEFVSETESRG

SEQ ID NO: 3498 - protein, 15 aa, Homo sapiens
LGQHLLPWMDRLSLE

SEQ ID NO: 3499 - protein, 15 aa, Homo sapiens
LINEYWVLTAAHVVE

SEQ ID NO: 3500 - protein, 17 aa, Homo sapiens
LKQEYFVVAATLQDIIR

SEQ ID NO: 3501 - protein, 17 aa, Homo sapiens
LKTGKLVSLSAQNLVDC

SEQ ID NO: 3502 - protein, 16 aa, Homo sapiens
LMHPDALEEPDDQNRI

SEQ ID NO: 3503 - protein, 16 aa, Homo sapiens
LNQELRADGTVNQIEG

SEQ ID NO: 3504 - protein, 18 aa, Homo sapiens
LPQPDLRYLFLNGNKLAR

SEQ ID NO: 3505 - protein, 17 aa, Homo sapiens
LRVLRAQPVQVAEGSEP

SEQ ID NO: 3506 - protein, 16 aa, Homo sapiens
LSKELQAAQARLGADM

SEQ ID NO: 3507 - protein, 14 aa, Homo sapiens
LVAYYTLIGASGQR

SEQ ID NO: 3508 - protein, 13 aa, Homo sapiens
MQQKLVDQNIFSF

SEQ ID NO: 3509 - protein, 13 aa, Homo sapiens
MVKVLDAVRGSPA

SEQ ID NO: 3510 - protein, 16 aa, Homo sapiens
NDVKNVIIWGNHSSTQ

SEQ ID NO: 3511 - protein, 16 aa, Homo sapiens
NEEEIRANVAVVSGAP

SEQ ID NO: 3512 - protein, 23 aa, Homo sapiens
NLDFLKAVDTNRASVGQDSPEPR

SEQ ID NO: 3513 - protein, 15 aa, Homo sapiens
NPAEFVVNTSNAGAG

SEQ ID NO: 3514 - protein, 15 aa, Homo sapiens
NPGTFRILVGNKGCS

SEQ ID NO: 3515 - protein, 18 aa, Homo sapiens
NPGTFRILVGNKGCSHPS

SEQ ID NO: 3516 - protein, 17 aa, Homo sapiens
NPLEIVSIPDNHGHIDP

SEQ ID NO: 3517 - protein, 15 aa, Homo sapiens
NSNQIKILGNQGSFL

SEQ ID NO: 3518 - protein, 16 aa, Homo sapiens
NVPTIDIHMNQIGFER

SEQ ID NO: 3519 - protein, 16 aa, Homo sapiens
QGGTYSKASTPNGYDN

SEQ ID NO: 3520 - protein, 16 aa, Homo sapiens
QPLGMISLMKRPPGFS

SEQ ID NO: 3521 - protein, 15 aa, Homo sapiens
QSGEYWIDPNQGSVE

SEQ ID NO: 3522 - protein, 25 aa, Homo sapiens
QSLPHENKPLTLSNYQTNKAKHDEL

SEQ ID NO: 3523 - protein, 19 aa, Homo sapiens
QTVAVGVIKAVDKKAAGAG

SEQ ID NO: 3524 - protein, 13 aa, Homo sapiens
RIEGSNKVPVDPA

SEQ ID NO: 3525 - protein, 16 aa, Homo sapiens
RLPGLAKQPSFRQYSG

SEQ ID NO: 3526 - protein, 16 aa, Homo sapiens
RPLLDKWPTTLSRHLG

SEQ ID NO: 3527 - protein, 16 aa, Homo sapiens
RPRAPIIAVTRNPQTA

SEQ ID NO: 3528 - protein, 15 aa, Homo sapiens
SARLTWDPTSRQING

SEQ ID NO: 3529 - protein, 16 aa, Homo sapiens
SDTSYVSLKAPLTKPL

SEQ ID NO: 3530 - protein, 15 aa, Homo sapiens
SDVDLIPMNDHNAYR

SEQ ID NO: 3531 - protein, 13 aa, Homo sapiens
SFYLSRDPDAQPG

SEQ ID NO: 3532 - protein, 16 aa, Homo sapiens
SGDVFTALIGEIASPN

SEQ ID NO: 3533 - protein, 18 aa, Homo sapiens
SGKPQYMVLVPSLLHTET

SEQ ID NO: 3534 - protein, 18 aa, Homo sapiens
SGLEVIDAMRSQLGKATA

SEQ ID NO: 3535 - protein, 17 aa, Homo sapiens
SKNTLYLQMNSLRAEDT

SEQ ID NO: 3536 - protein, 19 aa, Homo sapiens
SLRPKDYEVDATLKSLNNQ

SEQ ID NO: 3537 - protein, 17 aa, Homo sapiens
SPDRIFFHLNAVALGDG

SEQ ID NO: 3538 - protein, 18 aa, Homo sapiens
SPERPFLAILGGAKVADK

SEQ ID NO: 3539 - protein, 17 aa, Homo sapiens
SPLSVALALSHLALGAQ

SEQ ID NO: 3540 - protein, 14 aa, Homo sapiens
SPMYSIITPNILRL

SEQ ID NO: 3541 - protein, 19 aa, Homo sapiens
SPPISYIWYKQQTNNQEPI

SEQ ID NO: 3542 - protein, 19 aa, Homo sapiens
SPVTGYRVTTTPKNGPGPT

SEQ ID NO: 3543 - protein, 17 aa, Homo sapiens
SRLPIIDVAPLDVGAPD

SEQ ID NO: 3544 - protein, 16 aa, Homo sapiens
SYAGKYVPAIAHLIHS

SEQ ID NO: 3545 - protein, 15 aa, Homo sapiens
TAADYKILGGSVLHL

SEQ ID NO: 3546 - protein, 21 aa, Homo sapiens
TEEEFVEGIYKVEIDTKSYWK

SEQ ID NO: 3547 - protein, 18 aa, Homo sapiens
TGAQELLRVLRAQPVQVA

SEQ ID NO: 3548 - protein, 18 aa, Homo sapiens
TGDAYVILKTVQLRNGNL

SEQ ID NO: 3549 - protein, 14 aa, Homo sapiens
TGKLVSLSAQNLVD

SEQ ID NO: 3550 - protein, 15 aa, Homo sapiens
TGKLVSLSAQNLVDC

SEQ ID NO: 3551 - protein, 15 aa, Homo sapiens
TGNYRIESVLSSSGK

SEQ ID NO: 3552 - protein, 15 aa, Homo sapiens
THMLDVMQDHFSRAS

SEQ ID NO: 3553 - protein, 16 aa, Homo sapiens
TIYVIALKNNQKSEPL

SEQ ID NO: 3554 - protein, 16 aa, Homo sapiens
TLNQIDEVKVWPQQPS

SEQ ID NO: 3555 - protein, 16 aa, Homo sapiens
TLQSFRQDVDNASLAR

SEQ ID NO: 3556 - protein, 17 aa, Homo sapiens
TSATNIVKWITKQQNAQ

SEQ ID NO: 3557 - protein, 15 aa, Homo sapiens
TTAFQYIIDNKGIDS

SEQ ID NO: 3558 - protein, 19 aa, Homo sapiens
VAIQLNDTHPSLAIPELMR

SEQ ID NO: 3559 - protein, 21 aa, Homo sapiens
VDDTQFVRFDSDAASPRTEPR

SEQ ID NO: 3560 - protein, 18 aa, Homo sapiens
VDDTSIVVRWSRPQAPIT

SEQ ID NO: 3561 - protein, 17 aa, Homo sapiens
VDMDFEVENAVLGKDFK

SEQ ID NO: 3562 - protein, 15 aa, Homo sapiens
VFNILRMMPKGAALH

SEQ ID NO: 3563 - protein, 19 aa, Homo sapiens
VGPVDEVRELQKAIGAVPL

SEQ ID NO: 3564 - protein, 15 aa, Homo sapiens
VHPKVTVYPSKTQPL

SEQ ID NO: 3565 - protein, 15 aa, Homo sapiens
VPPEWKALTDMPQMR

SEQ ID NO: 3566 - protein, 16 aa, Homo sapiens
VPVPVFCDMTTEGGKW

SEQ ID NO: 3567 - protein, 17 aa, Homo sapiens
VPVPVFCDMTTEGGKWT

SEQ ID NO: 3568 - protein, 14 aa, Homo sapiens
VPYVIVPLKTGLQE

SEQ ID NO: 3569 - protein, 15 aa, Homo sapiens
VSGTLVLLQGARGFA

SEQ ID NO: 3570 - protein, 15 aa, Homo sapiens
VSQYFQTVTDYGKDL

SEQ ID NO: 3571 - protein, 15 aa, Homo sapiens
VSTAFVYTKNPNGYS

SEQ ID NO: 3572 - protein, 19 aa, Homo sapiens
VVLPSYEEALSLPSKTPEG

SEQ ID NO: 3573 - protein, 15 aa, Homo sapiens
VVYYRVQNATLAVAN

SEQ ID NO: 3574 - protein, 18 aa, Homo sapiens
YDGKDYIALKEDLRSWTA

SEQ ID NO: 3575 - protein, 19 aa, Homo sapiens
YDGSHRYVILKSEPVHPFG

SEQ ID NO: 3576 - protein, 26 aa, Homo sapiens
YDLRHTFMGVVSLGSPSGEVSHPRKT

SEQ ID NO: 3577 - protein, 12 aa, Homo sapiens
YLQMNSLRVEDT

SEQ ID NO: 3578 - protein, 12 aa, Homo sapiens
YLQMNSVRAEDT

SEQ ID NO: 3579 - protein, 11 aa, Homo sapiens
YVNGLTLGGQK

SEQ ID NO: 3580 - protein, 15 aa, Homo sapiens
CDMNTENGGWTVIQN

SEQ ID NO: 3581 - protein, 15 aa, Homo sapiens
DVSAQMEYCRTPCTV

SEQ ID NO: 3582 - protein, 15 aa, Homo sapiens
DWPFCSDEDWNYKCP

SEQ ID NO: 3583 - protein, 15 aa, Homo sapiens
EAVQSTSSSSQFYMY

SEQ ID NO: 3584 - protein, 15 aa, Homo sapiens
FTNRINKLKNSLFEY

SEQ ID NO: 3585 - protein, 15 aa, Homo sapiens
GDKELRTGKEKVTSG

SEQ ID NO: 3586 - protein, 12 aa, Mycobacterium tuberculosis
GLEPGVVAEKVR

SEQ ID NO: 3587 - protein, 15 aa, Homo sapiens
GSSERGSAGHWTSES

SEQ ID NO: 3588 - protein, 15 aa, Homo sapiens
IRVLRSILENLRSKI

SEQ ID NO: 3589 - protein, 15 aa, Homo sapiens
ITSDPRKQCSKEDGG

SEQ ID NO: 3590 - protein, 15 aa, Homo sapiens
LENLRSKIQKLESDV

SEQ ID NO: 3591 - protein, 11 aa, Mycobacterium tuberculosis
LEPGVVAEKVR

SEQ ID NO: 3592 - protein, 15 aa, Homo sapiens
LLQQERPIRNSVDEL

SEQ ID NO: 3593 - protein, 15 aa, Homo sapiens
LMGENRTMTIHNGMF

SEQ ID NO: 3594 - protein, 15 aa, Homo sapiens
NSNIPTNLRVLRSIL

SEQ ID NO: 3595 - protein, 15 aa, Homo sapiens
PRKQCSKEDGGGWWY

SEQ ID NO: 3596 - protein, 15 aa, Homo sapiens
QKLESDVSAQMEYCR

SEQ ID NO: 3597 - protein, 15 aa, Homo sapiens
QKQLEQVIAKDLLPS

SEQ ID NO: 3598 - protein, 15 aa, Homo sapiens
QMEYCRTPCTVSCNI

SEQ ID NO: 3599 - protein, 15 aa, Homo sapiens
QNPGSPRPGSTGTWN

SEQ ID NO: 3600 - protein, 15 aa, Homo sapiens
SETESRGSESGIFTN

SEQ ID NO: 3601 - protein, 15 aa, Homo sapiens
SGCRMKGLIDEVNQD

SEQ ID NO: 3602 - protein, 15 aa, Homo sapiens
SGPGSTGNRNPGSSG

SEQ ID NO: 3603 - protein, 15 aa, Homo sapiens
TPCTVSCNIPVVSGK

SEQ ID NO: 3604 - protein, 15 aa, Homo sapiens
TTRRSCSKTVTKTVI

SEQ ID NO: 3605 - protein, 15 aa, Homo sapiens
TVQNEANKYQISVNK

SEQ ID NO: 3606 - protein, 15 aa, Homo sapiens
VDIDIKIRSCRGSCS

SEQ ID NO: 3607 - protein, 15 aa, Homo sapiens
VDIDIKIRSCRGSCS

SEQ ID NO: 3608 - protein, 15 aa, Homo sapiens
VSPGTRREYHTEKLV

SEQ ID NO: 3609 - protein, 15 aa, Homo sapiens
VVWMNWKGSWYSMRK

SEQ ID NO: 3610 - protein, 15 aa, Homo sapiens
WYNRCHAANPNGRYY

SEQ ID NO: 3611 - protein, 15 aa, Homo sapiens
WYSMRKMSMKIRPFF

SEQ ID NO: 3612 - protein, 15 aa, Homo sapiens
YCGLPGEYWLGNDKI

SEQ ID NO: 3613 - protein, 17 aa, Homo sapiens
NEEGFFSARGHRPLDKK

SEQ ID NO: 3614 - protein, 15 aa, Homo sapiens
GPRVVERHQSACKDS

SEQ ID NO: 3615 - protein, 17 aa, Homo sapiens
KIHAREIFDSRGNPTVE

SEQ ID NO: 3616 - protein, 15 aa, Homo sapiens
VYATRSSAVRLRSSV

SEQ ID NO: 3617 - protein, 20 aa, Homo sapiens
GVYATRSSAVRLRSSVPGVR

SEQ ID NO: 3618 - protein, 20 aa, Homo sapiens
GVYATRSSAVRLRSSVPGVR

SEQ ID NO: 3619 - protein, 5 aa, Homo sapiens
GYRAR

SEQ ID NO: 3620 - protein, 4 aa, Homo sapiens
RVVE

SEQ ID NO: 3621 - protein, 15 aa, Homo sapiens
SGIGTLDGFRHRHPD

SEQ ID NO: 3622 - protein, 5 aa, Homo sapiens
VERHQ

SEQ ID NO: 3623 - protein, 20 aa, Homo sapiens
AAAIAYGLDKREGEKNILVF

SEQ ID NO: 3624 - protein, 20 aa, Homo sapiens
AGTIAGLNVMRIINEPTAAA

SEQ ID NO: 3625 - protein, 20 aa, Homo sapiens
AKFEELNMDLFRSTMKPVQK

SEQ ID NO: 3626 - protein, 20 aa, Homo sapiens
AKRALSSQHQARIEIESFYE

SEQ ID NO: 3627 - protein, 20 aa, Homo sapiens
AKRALSSQHQARIEIESFYE

SEQ ID NO: 3628 - protein, 20 aa, Homo sapiens
ATNGDTHLGGEDFDQRVMEH

SEQ ID NO: 3629 - protein, 20 aa, Homo sapiens
EDKKEDVGTVVGIDLGTTYS

SEQ ID NO: 3630 - protein, 21 aa, Homo sapiens
EDKKLKERIDTRNELESYAYS

SEQ ID NO: 3631 - protein, 20 aa, Homo sapiens
ESHQDADIEDFKAKKKELEE

SEQ ID NO: 3632 - protein, 20 aa, Homo sapiens
FAEEDKKLKERIDTRNELES

SEQ ID NO: 3633 - protein, 20 aa, Homo sapiens
GSAGPPPTGEEDTAELHHHH

SEQ ID NO: 3634 - protein, 20 aa, Homo sapiens
IDEIVLVGGSTRIPKIQQLV

SEQ ID NO: 3635 - protein, 20 aa, Homo sapiens
KDNRAVQKLRREVEKAKRAL

SEQ ID NO: 3636 - protein, 20 aa, Homo sapiens
KETMEKAVEEKIEWLESHQD

SEQ ID NO: 3637 - protein, 16 aa, Homo sapiens
KIHAREIFDSRGNPTV

SEQ ID NO: 3638 - protein, 20 aa, Homo sapiens
KLRREVEKAKRALSSQHQAR

SEQ ID NO: 3639 - protein, 20 aa, Homo sapiens
KTGKDVRKDNRAVQKLRREV

SEQ ID NO: 3640 - protein, 20 aa, Homo sapiens
KTGKDVRKDNRAVQKLRREV

SEQ ID NO: 3641 - protein, 20 aa, Homo sapiens
LYKKKTGKDVRKDNRAVQKL

SEQ ID NO: 3642 - protein, 20 aa, Homo sapiens
NKITITNDQNRLTPEEIERM

SEQ ID NO: 3643 - protein, 20 aa, Homo sapiens
NPENTVFDAKRLIGRTWNDP

SEQ ID NO: 3644 - protein, 20 aa, Homo sapiens
QNRLTPEEIERMVNDAEKFA

SEQ ID NO: 3645 - protein, 20 aa, Homo sapiens
RKDNRAVQKLRREVEKAKRA

SEQ ID NO: 3646 - protein, 20 aa, Homo sapiens
RKDNRAVQKLRREVEKAKRA

SEQ ID NO: 3647 - protein, 20 aa, Homo sapiens
SYVAFTPEGERLIGDAAKNQ

SEQ ID NO: 3648 - protein, 20 aa, Homo sapiens
TFEIDVNGILRVTAEDKGTG

SEQ ID NO: 3649 - protein, 20 aa, Homo sapiens
TFEIDVNGILRVTAEDKGTG

SEQ ID NO: 3650 - protein, 20 aa, Homo sapiens
TVGGVMTKLIPRNTVVPTKK

SEQ ID NO: 3651 - protein, 20 aa, Homo sapiens
TVPAYFNDAQRQATKDAGTI

SEQ ID NO: 3652 - protein, 20 aa, Homo sapiens
TVTIKVYEGERPLTKDNHLL

SEQ ID NO: 3653 - protein, 20 aa, Homo sapiens
VEIIANDQGNRITPSYVAFT

SEQ ID NO: 3654 - protein, 20 aa, Homo sapiens
VKEFFNGKEPSRGINPDEAV

SEQ ID NO: 3655 - protein, 20 aa, Homo sapiens
YEGEDFSETLTRAKFEELNM

SEQ ID NO: 3656 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3657 - protein, 15 aa, Rattus norvegicus
GIAGFKGEQGPKGET

SEQ ID NO: 3658 - protein, 15 aa, Rattus norvegicus
GIAGFKGEQGPKGET

SEQ ID NO: 3659 - protein, 15 aa, Rattus norvegicus
GIAGFKGEQGPKGET

SEQ ID NO: 3660 - protein, 15 aa, unidentified
  REGION 1..15: note = epitope involved in rheumatoid arthritis
GIAGNKGDQGPKGEB

SEQ ID NO: 3661 - protein, 20 aa, Mycobacterium tuberculosis
TLVVNKIRGTFKSVAVKAPG

SEQ ID NO: 3662 - protein, 20 aa, Chlamydia pneumoniae
TLVVNKLQGLLQVTVVTIPQ

SEQ ID NO: 3663 - protein, 14 aa, Homo sapiens
LTVGLTRRGQPRQY

SEQ ID NO: 3664 - protein, 14 aa, Homo sapiens
LTVGLTRRGQPRQY

SEQ ID NO: 3665 - protein, 13 aa, Homo sapiens
YNQYSQRYHQRTN

SEQ ID NO: 3666 - protein, 13 aa, Homo sapiens
APAPTARNKLTSE

SEQ ID NO: 3667 - protein, 21 aa, Homo sapiens
DAPRAVFPSIVGRPRHQGVMV

SEQ ID NO: 3668 - protein, 12 aa, Homo sapiens
EAQSKRGILTLK

SEQ ID NO: 3669 - protein, 11 aa, Homo sapiens
ERLGPLVEQGR

SEQ ID NO: 3670 - protein, 10 aa, Homo sapiens
GPSIVHRKCF

SEQ ID NO: 3671 - protein, 16 aa, Homo sapiens
IWHHTFYNELRVAPEE

SEQ ID NO: 3672 - protein, 15 aa, Homo sapiens
KLTSEARGRIPVAQK

SEQ ID NO: 3673 - protein, 20 aa, Homo sapiens
LAVYQAGAREGAERGLSAIR

SEQ ID NO: 3674 - protein, 14 aa, Homo sapiens
LDLAGRDLTDYLMK

SEQ ID NO: 3675 - protein, 27 aa, Homo sapiens
MKILTERGYSFTTTAEREIVRDIKEKL

SEQ ID NO: 3676 - protein, 11 aa, Homo sapiens
PGIADRMQKEI

SEQ ID NO: 3677 - protein, 13 aa, Homo sapiens
RQVDARRNVPQND

SEQ ID NO: 3678 - protein, 13 aa, Homo sapiens
QYMRADQAAGGLR

SEQ ID NO: 3679 - protein, 13 aa, Homo sapiens
SAVRARSSVPGVR

SEQ ID NO: 3680 - protein, 19 aa, Homo sapiens
ALMRGKSTEEARKELQAAG

SEQ ID NO: 3681 - protein, 19 aa, Homo sapiens
AMLPYDQYLHRFAAYFQQG

SEQ ID NO: 3682 - protein, 19 aa, Homo sapiens
ASTNGLINFIKQQREARVQ

SEQ ID NO: 3683 - protein, 19 aa, Homo sapiens
DLAKSRGVEAARERMFNGE

SEQ ID NO: 3684 - protein, 19 aa, Homo sapiens
EDLERLLPHKVFEGNRPTN

SEQ ID NO: 3685 - protein, 19 aa, Homo sapiens
FEFWDWVGGRYSLWSAIGL

SEQ ID NO: 3686 - protein, 19 aa, Homo sapiens
KLQQWYREHRSELNLRRLF

SEQ ID NO: 3687 - protein, 19 aa, Homo sapiens
NYTEGRAVLHVALRNRSNT

SEQ ID NO: 3688 - protein, 19 aa, Homo sapiens
SFCQRVRSGDWKGYTGKTI

SEQ ID NO: 3689 - protein, 16 aa, Homo sapiens
VYATRSSAVRLRSSVP

SEQ ID NO: 3690 - protein, 17 aa, Homo sapiens
NEEGFFSARGHRPLDKK

SEQ ID NO: 3691 - protein, 19 aa, Homo sapiens
SHQESTRGRSRGRSGRSGS

SEQ ID NO: 3692 - protein, 5 aa, Homo sapiens
TRGRS

SEQ ID NO: 3693 - protein, 36 aa, unidentified
  REGION 1..36: note = epitope involved in rheumatoid arthritis
HSTKRGHAKSRPVRGHQSHQESTRGRSRGRSGRSGS

SEQ ID NO: 3694 - protein, 15 aa, Trypanosoma cruzi
AEEEEDDDMGFGLFD

SEQ ID NO: 3695 - protein, 32 aa, Trypanosoma cruzi
ASAPTAAAAASGGAAAPAAAAEEEEDDDMGFG

SEQ ID NO: 3696 - protein, 35 aa, Trypanosoma cruzi
ASAPTAAAAASGGAAAPAAAAEEEEDDDMGFGLFD

SEQ ID NO: 3697 - protein, 18 aa, Homo sapiens
CAPESIEFPVSEARVLED

SEQ ID NO: 3698 - protein, 10 aa, Homo sapiens
DDDMGFGLFD

SEQ ID NO: 3699 - protein, 16 aa, Mycobacterium tuberculosis
DLSLLGKARKVVVTKD

SEQ ID NO: 3700 - protein, 13 aa, Trypanosoma cruzi
EEEDDDMGFGLFD

SEQ ID NO: 3701 - protein, 13 aa, Homo sapiens
EESDDDMGFGLFD

SEQ ID NO: 3702 - protein, 17 aa, Homo sapiens
ENPVVHFFKNIVTPRTP

SEQ ID NO: 3703 - protein, 5 aa, Homo sapiens
ERKRR

SEQ ID NO: 3704 - protein, 12 aa, Mus musculus
FYNQKFKGKATL

SEQ ID NO: 3705 - protein, 15 aa, Human herpesvirus
GDDGDDGDEGGDGDE

SEQ ID NO: 3706 - protein, 24 aa, Human herpesvirus
GGDNHGRGRGRGRGRGGGRPGAPG

SEQ ID NO: 3707 - protein, 9 aa, Human herpesvirus
GLCTLVAML

SEQ ID NO: 3708 - protein, 18 aa, Homo sapiens
GPSQQVMTPQGRGTVAAA

SEQ ID NO: 3709 - protein, 10 aa, Homo sapiens
HLKAVKMTLK

SEQ ID NO: 3710 - protein, 9 aa, Homo sapiens
ILQDGRIFI

SEQ ID NO: 3711 - protein, 22 aa, Artemia franciscana
KKEEKKEESEEEDEDMGFGLFD

SEQ ID NO: 3712 - protein, 24 aa, Mus musculus
KRHRKVLRDNIQGITKPAIRRLAR

SEQ ID NO: 3713 - protein, 17 aa, Homo sapiens
KRVLGLVLLRGENLVSM

SEQ ID NO: 3714 - protein, 7 aa, Trypanosoma cruzi
MGFGLFD

SEQ ID NO: 3715 - protein, 20 aa, Homo sapiens
PTRAETREERMERKRREKIE

SEQ ID NO: 3716 - protein, 16 aa, Homo sapiens
QPHDLGKVGEVIVTKD

SEQ ID NO: 3717 - protein, 9 aa, Homo sapiens
SIRGNNIRY

SEQ ID NO: 3718 - protein, 24 aa, Mus musculus
TYTEHAKRKTVTAMDVVYALKRQG

SEQ ID NO: 3719 - protein, 13 aa, Human herpesvirus
RGQGDGGRRKKGG

SEQ ID NO: 3720 - protein, 21 aa, Mus musculus
AAMAARPHSIDGRVVEPKRAV

SEQ ID NO: 3721 - protein, 22 aa, Mus musculus
AEVRKALSRQEMQEVQSSRSGR

SEQ ID NO: 3722 - protein, 16 aa, Homo sapiens
CKPISGHNSLFWYRQT

SEQ ID NO: 3723 - protein, 16 aa, Homo sapiens
DAGVIQSPRHEVTEMG

SEQ ID NO: 3724 - protein, 21 aa, Mus musculus
DKIVLQKYHTINGHNAEVRKA

SEQ ID NO: 3725 - protein, 10 aa, Homo sapiens
DPISGHVSLF

SEQ ID NO: 3726 - protein, 16 aa, Homo sapiens
KIQPSEPRDSAVYFCA

SEQ ID NO: 3727 - protein, 10 aa, Homo sapiens
KPISGHNSLF

SEQ ID NO: 3728 - protein, 21 aa, Mus musculus
LTDCVVMRDPASKRSRGFGFV

SEQ ID NO: 3729 - protein, 21 aa, Mus musculus
MEREKEQFRKLFIGGLSFETT

SEQ ID NO: 3730 - protein, 16 aa, Homo sapiens
QPLKEQPALNDSRYCL

SEQ ID NO: 3731 - protein, 21 aa, Mus musculus
RGFGFVTFSSMAEVDAAMAAR

SEQ ID NO: 3732 - protein, 11 aa, Homo sapiens
RSLDFQATTMF

SEQ ID NO: 3733 - protein, 27 aa, Mus musculus
SGKPGAHVTVKKLFVGGIKEDTEEHHL

SEQ ID NO: 3734 - protein, 10 aa, Homo sapiens
SPRSGDLSVY

SEQ ID NO: 3735 - protein, 25 aa, Homo sapiens
AQGTLSKIFKLGGRDSRSGSPMARR

SEQ ID NO: 3736 - protein, 19 aa, Mus musculus
LSRFSWGAEGQKPGFGYGG

SEQ ID NO: 3737 - protein, 21 aa, Mus musculus
MEVGWYRSPFSRVVHLYRNGK

SEQ ID NO: 3738 - protein, 18 aa, Homo sapiens
KEQFLDGDGWTSRWIESK

SEQ ID NO: 3739 - protein, 21 aa, Homo sapiens
RIHMVYSKRSGKPRGYAFIEY

SEQ ID NO: 3740 - protein, 10 aa, Homo sapiens
YTCPLCRAPV

SEQ ID NO: 3741 - protein, 10 aa, Homo sapiens
DWEYSVWLSN

SEQ ID NO: 3742 - protein, 19 aa, Homo sapiens
GYYWSWIRQPPGKGEEWIG

SEQ ID NO: 3743 - protein, 9 aa, Homo sapiens
KGEQGEPGA

SEQ ID NO: 3744 - protein, 18 aa, Homo sapiens
VTWEVLEGEVEKEALKKI

SEQ ID NO: 3745 - protein, 26 aa, Homo sapiens
AGAARDALQGFKITQNNAMKISFAKK

SEQ ID NO: 3746 - protein, 20 aa, Homo sapiens
ANNGNLQLRNKEVTWEVLEG

SEQ ID NO: 3747 - protein, 21 aa, Homo sapiens
DGYVWQVTDMNRLHRFLCFGS

SEQ ID NO: 3748 - protein, 15 aa, Bos taurus
DVVYALKRQGRTLYG

SEQ ID NO: 3749 - protein, 18 aa, Bos taurus
DVVYALKRQGRTLYGFGG

SEQ ID NO: 3750 - protein, 13 aa, Artemia franciscana
EEEDEDMGFGLFD

SEQ ID NO: 3751 - protein, 22 aa, Homo sapiens
ELYKEKALSVETEKLLKYLEAV

SEQ ID NO: 3752 - protein, 24 aa, Homo sapiens
EPAVYFKEQFLDGDGWTSRWIESK

SEQ ID NO: 3753 - protein, 15 aa, Bos taurus
GITKPAIRRLARRGG

SEQ ID NO: 3754 - protein, 23 aa, Homo sapiens
GRGRGRGRGRGRGRGRGRGGPRR

SEQ ID NO: 3755 - protein, 16 aa, Homo sapiens
GSGKGKVQFQGKKTKF

SEQ ID NO: 3756 - protein, 17 aa, Homo sapiens
KALSVETEKLLKYLEAV

SEQ ID NO: 3757 - protein, 24 aa, Homo sapiens
KLIVCGMTSNGFTIADPDDRGMLD

SEQ ID NO: 3758 - protein, 24 aa, Homo sapiens
KMTLKNREPVQLETLSIRGNRIRY

SEQ ID NO: 3759 - protein, 15 aa, Homo sapiens
KPKAAKPKKAAAKKK

SEQ ID NO: 3760 - protein, 11 aa, Homo sapiens
MAVPETRPNHT

SEQ ID NO: 3761 - protein, 23 aa, Homo sapiens
MEESVNQMQPLNEKQIANSQDGY

SEQ ID NO: 3762 - protein, 20 aa, Homo sapiens
MKLVRFLMKLSHETVTIELK

SEQ ID NO: 3763 - protein, 17 aa, Enterovirus A
MVTSTITEKLLKNLVKI

SEQ ID NO: 3764 - protein, 10 aa, Homo sapiens
NGWSHKDLLR

SEQ ID NO: 3765 - protein, 7 aa, Homo sapiens
PPGMRPP

SEQ ID NO: 3766 - protein, 21 aa, Mus musculus
PTRAETREERMERKRREKIER

SEQ ID NO: 3767 - protein, 11 aa, Homo sapiens
PTRAPSGPRPP

SEQ ID NO: 3768 - protein, 21 aa, Mus musculus
RIHMVYSKRSGKPRGYAFIEY

SEQ ID NO: 3769 - protein, 21 aa, Mus musculus
RIHMVYSKRSGKPRGYAFIEY

SEQ ID NO: 3770 - protein, 20 aa, Homo sapiens
RPDAEYWNSQKDLLEQKRGR

SEQ ID NO: 3771 - protein, 20 aa, Homo sapiens
RPDAEYWNSQKDLLEQRRAA

SEQ ID NO: 3772 - protein, 11 aa, Homo sapiens
RRREGPDRSPR

SEQ ID NO: 3773 - protein, 29 aa, Bos taurus
SGRGKGGKGLGKGGAKRHRKVLRDNIQGI

SEQ ID NO: 3774 - protein, 24 aa, Homo sapiens
SQFGQILDILVSRSLKMRGQAFVI

SEQ ID NO: 3775 - protein, 15 aa, Homo sapiens
TGALDVIRNFTLDMI

SEQ ID NO: 3776 - protein, 18 aa, Bos taurus
TKPAIRRLARRGGVKRIS

SEQ ID NO: 3777 - protein, 22 aa, Homo sapiens
TKYKQRNGWSHKDLLRLSHLKP

SEQ ID NO: 3778 - protein, 20 aa, Homo sapiens
TLHKAFKGSIFVVFDSIESA

SEQ ID NO: 3779 - protein, 21 aa, Homo sapiens
VCEKLCNEKLLKKARIHPFHI

SEQ ID NO: 3780 - protein, 37 aa, Homo sapiens; identical to SEQ ID NO: 3149

SEQ ID NO: 3781 - protein, 15 aa, Homo sapiens
VSKDDSIISSLDVTD

SEQ ID NO: 3782 - protein, 20 aa, Mus musculus
YDERPGPSPLPHRDRDRDRE

SEQ ID NO: 3783 - protein, 21 aa, Mus musculus
YLPPLEKLPHEKHHNQPYCGI

SEQ ID NO: 3784 - protein, 15 aa, Homo sapiens
AARGRGRGMGRGNIF

SEQ ID NO: 3785 - protein, 15 aa, Homo sapiens
AARGRGRGMGRGNIF

SEQ ID NO: 3786 - protein, 15 aa, Homo sapiens
AIALREYRKKMDIPA

SEQ ID NO: 3787 - protein, 20 aa, Homo sapiens
AIVTKYITKGWKEVHELYKE

SEQ ID NO: 3788 - protein, 20 aa, Homo sapiens
ANNGNLQLRNKEVTWEVLEG

SEQ ID NO: 3789 - protein, 15 aa, Homo sapiens
ARGRGRGMGRGNIFQ

SEQ ID NO: 3790 - skipped

SEQ ID NO: 3791 - protein, 6 aa, Homo sapiens
DGQFCH

SEQ ID NO: 3792 - protein, 20 aa, Homo sapiens
DLLRLSHLKPSSEGLAIVTK

SEQ ID NO: 3793 - protein, 15 aa, Homo sapiens
DVEPKVKSKKREAVA

SEQ ID NO: 3794 - protein, 15 aa, Homo sapiens
DVEPKVKSKKREAVA

SEQ ID NO: 3795 - protein, 15 aa, Homo sapiens
EAVAGRGRGRGRGRG

SEQ ID NO: 3796 - protein, 18 aa, Homo sapiens
EKALSVETEKLLKYLEAV

SEQ ID NO: 3797 - protein, 13 aa, Homo sapiens
ERDRKREKRKPKS

SEQ ID NO: 3798 - protein, 8 aa, Homo sapiens
GQIPPGAM

SEQ ID NO: 3799 - protein, 15 aa, Homo sapiens
GRGRGMGRGNIFQKR

SEQ ID NO: 3800 - protein, 13 aa, Homo sapiens
GRGRGRGRGGPRR

SEQ ID NO: 3801 - protein, 15 aa, Homo sapiens
GRGRGRGRGRGGPRR

SEQ ID NO: 3802 - protein, 15 aa, Homo sapiens
GRGRGRGRGRGGPRR

SEQ ID NO: 3803 - protein, 13 aa, Homo sapiens
GRGRGRGRGRGRG

SEQ ID NO: 3804 - protein, 15 aa, Homo sapiens
GRGRGRGRGRGRGGP

SEQ ID NO: 3805 - protein, 15 aa, Homo sapiens
GRGRGRGRGRGRGRG

SEQ ID NO: 3806 - protein, 13 aa, Homo sapiens
GRGTVAAAAAAAT

SEQ ID NO: 3807 - protein, 16 aa, Homo sapiens
GSGKGKVQFQGKKTKF

SEQ ID NO: 3808 - protein, 12 aa, Homo sapiens
HMVYSKRSGKPR

SEQ ID NO: 3809 - protein, 27 aa, Homo sapiens
IPPGRGTPMGMPPPGMRPPPPGMRGLL

SEQ ID NO: 3810 - protein, 20 aa, Homo sapiens
KALSVETEKLLKYLEAVEKV

SEQ ID NO: 3811 - protein, 12 aa, Homo sapiens
KEEGSRSNLGWL

SEQ ID NO: 3812 - protein, 12 aa, Mus musculus
KFKGKATLTSDK

SEQ ID NO: 3813 - protein, 15 aa, Homo sapiens
KREAVAGRGRGRGRG

SEQ ID NO: 3814 - protein, 20 aa, Homo sapiens
KRTKDELEVIHLIEEHRLVR

SEQ ID NO: 3815 - protein, 13 aa, Homo sapiens
KVKSKKREAVAGR

SEQ ID NO: 3816 - protein, 15 aa, Homo sapiens
LDGPTYKRRLDECEE

SEQ ID NO: 3817 - protein, 13 aa, Homo sapiens
LKAVKMTLKNREP

SEQ ID NO: 3818 - protein, 15 aa, Homo sapiens
LKYYLAPKIEDEEGS

SEQ ID NO: 3819 - protein, 39 aa, Homo sapiens
MFEARLVQGSILKKVLEALKDLINEACWDISSSGVNLQS

SEQ ID NO: 3820 - protein, 13 aa, Homo sapiens
NTHLKAVKMTLKN

SEQ ID NO: 3821 - protein, 12 aa, Homo sapiens
NWHQLHGKKEAY

SEQ ID NO: 3822 - protein, 13 aa, Bos taurus
PEPAKSAPAPKKG

SEQ ID NO: 3823 - protein, 25 aa, Bos taurus
PEPAKSAPAPKKGSKKAVTKAQKKD

SEQ ID NO: 3824 - protein, 7 aa, Simian virus 40
PKKKRKV

SEQ ID NO: 3825 - protein, 15 aa, Homo sapiens
PKVKSKKREAVAGRG

SEQ ID NO: 3826 - protein, 15 aa, Homo sapiens
PKVKSKKREAVAGRG

SEQ ID NO: 3827 - protein, 35 aa, Homo sapiens
PKVKSKKREAVAGRGRGRGRGRGRGRGRGRGGPRR

SEQ ID NO: 3828 - protein, 12 aa, Homo sapiens
QGFPFYDKPMRI

SEQ ID NO: 3829 - protein, 15 aa, Homo sapiens
QVAARGRGRGMGRGN

SEQ ID NO: 3830 - protein, 6 aa, Homo sapiens
QVKGFV

SEQ ID NO: 3831 - protein, 40 aa, Homo sapiens
QYPPGRGGPPPPMGRGAPPPGMMGPPPGMRPPMGPPMGIP

SEQ ID NO: 3832 - protein, 12 aa, Homo sapiens
RCRLCDEGHGLE

SEQ ID NO: 3833 - protein, 13 aa, Homo sapiens
REAVAGRGRGRGR

SEQ ID NO: 3834 - protein, 15 aa, Homo sapiens
RGRGMGRGNIFQKRR

SEQ ID NO: 3835 - protein, 15 aa, Homo sapiens
RGRGRGMGRGNIFQK

SEQ ID NO: 3836 - protein, 13 aa, Homo sapiens
RGRGRGRGRGRGG

SEQ ID NO: 3837 - protein, 13 aa, Homo sapiens
RGRGRGRGRGRGR

SEQ ID NO: 3838 - protein, 13 aa, Homo sapiens
SKKREAVAGRGRG

SEQ ID NO: 3839 - protein, 15 aa, Homo sapiens
SKKREAVAGRGRGRG

SEQ ID NO: 3840 - protein, 22 aa, Homo sapiens
TKYKQRNGWSHKDLLRLSHLKP

SEQ ID NO: 3841 - protein, 22 aa, Homo sapiens
TKYKQRNGWSHKDLLRLSHLKP

SEQ ID NO: 3842 - protein, 12 aa, Homo sapiens
TVETQNLEGLHH

SEQ ID NO: 3843 - protein, 15 aa, Homo sapiens
VAARGRGRGMGRGNI

SEQ ID NO: 3844 - protein, 13 aa, Homo sapiens
VAGRGRGRGRGRG

SEQ ID NO: 3845 - protein, 15 aa, Homo sapiens
VAGRGRGRGRGRGRG

SEQ ID NO: 3846 - protein, 25 aa, Homo sapiens
VAGRGRGRGRGRGRGRGRGRGGPRR

SEQ ID NO: 3847 - protein, 6 aa, Homo sapiens
VCEHCD

SEQ ID NO: 3848 - protein, 35 aa, Homo sapiens
VEPKVKKREAVAGRGRGRGRGRGRGRGRGRGGPRR

SEQ ID NO: 3849 - protein, 13 aa, Homo sapiens
VEPKVKSKKREAV

SEQ ID NO: 3850 - protein, 15 aa, Homo sapiens
VEPKVKSKKREAVAG

SEQ ID NO: 3851 - protein, 15 aa, Homo sapiens
VEPKVKSKKREAVAG

SEQ ID NO: 3852 - protein, 15 aa, Homo sapiens
VKSKKREAVAGRGRG

SEQ ID NO: 3853 - protein, 15 aa, Homo sapiens
VKSKKREAVAGRGRG

SEQ ID NO: 3854 - protein, 11 aa, Homo sapiens
VLVDVERGRTV

SEQ ID NO: 3855 - protein, 13 aa, Homo sapiens
VSMNTHLKAVKMT

SEQ ID NO: 3856 - protein, 9 aa, Homo sapiens
YITTIAGVM

SEQ ID NO: 3857 - protein, 20 aa, Homo sapiens
YKQRNGWSHKDLLRLSHLKP

SEQ ID NO: 3858 - protein, 609 aa, Homo sapiens
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 3859 - protein, 119 aa, Homo sapiens
MKLVRFLMKLSHETVTIELKNGTQVHGTITGVDVSMNTHLKAVKMTLKNREPVQLETLSIRGNNIRYFILPDSLPLDTLLVDVEPKVKSKKREAVAGRGRGRGRGRGRGRGRGRGGPRR

SEQ ID NO: 3860 - protein, 10 aa, Homo sapiens
AAFYKTFKTV

SEQ ID NO: 3861 - protein, 15 aa, Homo sapiens
AEMKSLEEKIGCLLK

SEQ ID NO: 3862 - protein, 11 aa, Homo sapiens
ALLRNLGKMTA

SEQ ID NO: 3863 - protein, 14 aa, Homo sapiens
ALREYRKKMDIPAK

SEQ ID NO: 3864 - protein, 9 aa, Homo sapiens
AMKISFAKK

SEQ ID NO: 3865 - protein, 7 aa, Homo sapiens
APGMRPP

SEQ ID NO: 3866 - protein, 10 aa, Homo sapiens
APPPGMRPPM

SEQ ID NO: 3867 - protein, 19 aa, Mus musculus
APQGSLGEYLFERLTLKHD

SEQ ID NO: 3868 - protein, 15 aa, Homo sapiens
ATLDDIKEWLEDKGQ

SEQ ID NO: 3869 - protein, 14 aa, Homo sapiens
CSLPMIWAQKTNTP

SEQ ID NO: 3870 - protein, 9 aa, Homo sapiens
DRNGTHLDA

SEQ ID NO: 3871 - protein, 20 aa, Mus musculus
DSCPLDCKVYVGNLGNNGNK

SEQ ID NO: 3872 - protein, 9 aa, Homo sapiens
EALTKHFQD

SEQ ID NO: 3873 - protein, 14 aa, Homo sapiens
EAVEKVKRTKDELE

SEQ ID NO: 3874 - protein, 14 aa, Homo sapiens
EKVKRTKDELEVIH

SEQ ID NO: 3875 - protein, 15 aa, Homo sapiens
EQEAKQKLEEDAEMK

SEQ ID NO: 3876 - protein, 50 aa, Homo sapiens
FNGTFVKLNKASINMLRIVEPYIAWGYPNLKSVNELIYKRGYGKINKKRI

SEQ ID NO: 3877 - protein, 30 aa, Homo sapiens
GDAFKTLFVARVNYDTTESKLRREFEVYGP

SEQ ID NO: 3878 - protein, 21 aa, Homo sapiens
GIIDLIEKRKFNQNSNSTYCV

SEQ ID NO: 3879 - protein, 10 aa, Homo sapiens
GIMAPPPGMR

SEQ ID NO: 3880 - protein, 10 aa, Homo sapiens
GMRPPMGPPI

SEQ ID NO: 3881 - protein, 13 aa, Homo sapiens
GQILDILVSRSLK

SEQ ID NO: 3882 - protein, 20 aa, Mus musculus
HHNTLVCSVTDFYPAKIKVR

SEQ ID NO: 3883 - protein, 8 aa, Homo sapiens
HKAFKGSI

SEQ ID NO: 3884 - protein, 8 aa, Homo sapiens
HKGFKGVD

SEQ ID NO: 3885 - protein, 16 aa, Homo sapiens
HLLTNHLKSKEVWKAL

SEQ ID NO: 3886 - protein, 20 aa, Mus musculus
HLQLAIRNDEELNKLLGKVT

SEQ ID NO: 3887 - protein, 18 aa, Mus musculus
HPPHIEIQMLKNGKKIPK

SEQ ID NO: 3888 - protein, 9 aa, Homo sapiens
IIAKMKGTF

SEQ ID NO: 3889 - protein, 10 aa, Homo sapiens
IMAPPPGMRP

SEQ ID NO: 3890 - protein, 15 aa, Homo sapiens
KFVETPGQKYKETDL

SEQ ID NO: 3891 - protein, 11 aa, Homo sapiens
KIKKDELKKSL

SEQ ID NO: 3892 - protein, 15 aa, Homo sapiens
LAVTKYKQRNGWSHK

SEQ ID NO: 3893 - protein, 40 aa, Homo sapiens
LEKDEREQLRILGEKEAKLAQQSQALQELISELDRRCHSS

SEQ ID NO: 3894 - protein, 9 aa, Homo sapiens
LKRVCAQIN

SEQ ID NO: 3895 - protein, 36 aa, Homo sapiens
LQELEKDEREQLRILGEKEAKLAQQSQALQELISEL

SEQ ID NO: 3896 - protein, 49 aa, Homo sapiens
LQELEKDEREQLRILGEKEAKLAQQSQALQELISELDRRCHSSALELLQ

SEQ ID NO: 3897 - protein, 9 aa, Homo sapiens
LRLSHLKPS

SEQ ID NO: 3898 - protein, 30 aa, Homo sapiens
LTLPKVEAMNKRLGSLVDEFKELVYPPDYN

SEQ ID NO: 3899 - protein, 8 aa, Homo sapiens
LYKEKALS

SEQ ID NO: 3900 - protein, 10 aa, Homo sapiens
MAPPPGMRPP

SEQ ID NO: 3901 - protein, 26 aa, Homo sapiens
MEGVEEKKKEVPAVPETLKKKRRNFA

SEQ ID NO: 3902 - protein, 12 aa, Homo sapiens
MGRGAPPPGMMG

SEQ ID NO: 3903 - protein, 9 aa, Homo sapiens
MKCGMWGRA

SEQ ID NO: 3904 - protein, 24 aa, Homo sapiens
MLRKARRKLIYEKAKHYHKEYRQM

SEQ ID NO: 3905 - protein, 10 aa, Homo sapiens
MRPPMGPPIG

SEQ ID NO: 3906 - protein, 11 aa, Homo sapiens
MWGRALRKAIA

SEQ ID NO: 3907 - protein, 14 aa, Homo sapiens
NEKLLKKARIHPFH

SEQ ID NO: 3908 - protein, 9 aa, Homo sapiens
NLNEKIKKD

SEQ ID NO: 3909 - protein, 10 aa, Homo sapiens
PGIMAPPPGM

SEQ ID NO: 3910 - protein, 10 aa, Homo sapiens
PGMRPPMGPP

SEQ ID NO: 3911 - protein, 20 aa, Mus musculus
PGVTVKDVNQQEFVRALAAF

SEQ ID NO: 3912 - protein, 10 aa, Homo sapiens
PPGMRPPMGP

SEQ ID NO: 3913 - protein, 8 aa, Homo sapiens
PPPGIRGP

SEQ ID NO: 3914 - protein, 7 aa, Homo sapiens
PPPGMRP

SEQ ID NO: 3915 - protein, 8 aa, Homo sapiens
PPPGMRPP

SEQ ID NO: 3916 - protein, 10 aa, Homo sapiens
PPPGMRPPMG

SEQ ID NO: 3917 - protein, 16 aa, Homo sapiens
QEMPLTALLRNLGKMT

SEQ ID NO: 3918 - protein, 9 aa, Homo sapiens
QETPATKKA

SEQ ID NO: 3919 - protein, 24 aa, Homo sapiens
RAYGLKSGLKKQELLEALTKHFQD

SEQ ID NO: 3920 - protein, 34 aa, Homo sapiens
RILELDQFKGQQGQKRFQDMMGHGSDYSLSEVLW

SEQ ID NO: 3921 - protein, 18 aa, Homo sapiens
RKGHFLLSSKSGFWTIWL

SEQ ID NO: 3922 - protein, 14 aa, Mus musculus
RMVNHFIAEFKRKH

SEQ ID NO: 3923 - protein, 15 aa, Mus musculus
RQVRFYDGVIELSLT

SEQ ID NO: 3924 - protein, 10 aa, Homo sapiens
RSGKPRGYAF

SEQ ID NO: 3925 - protein, 10 aa, Homo sapiens
RSLKMRGQAF

SEQ ID NO: 3926 - protein, 11 aa, Homo sapiens
SDDDMGFGLFD

SEQ ID NO: 3927 - protein, 12 aa, Homo sapiens
SEEELKTHISKG

SEQ ID NO: 3928 - protein, 50 aa, Homo sapiens
SEEELKTHISKGTLGKFTVPMLKEACRAYGLKSGLKKQELLEALTKHFQD

SEQ ID NO: 3929 - protein, 9 aa, Homo sapiens
SQEGRTTKQ

SEQ ID NO: 3930 - protein, 21 aa, Homo sapiens
SRIHAEFVQQKNFLVEEEQRQ

SEQ ID NO: 3931 - protein, 10 aa, Homo sapiens
STKQAAFKAV

SEQ ID NO: 3932 - protein, 8 aa, Homo sapiens
TEKLLKYL

SEQ ID NO: 3933 - protein, 12 aa, Homo sapiens
TFIQFKKDLKES

SEQ ID NO: 3934 - protein, 11 aa, Homo sapiens
TYYIKEQKLGL

SEQ ID NO: 3935 - protein, 9 aa, Homo sapiens
VEPTGKRFL

SEQ ID NO: 3936 - protein, 19 aa, Mus musculus
VFRRYVEVGRVAYISFSPH

SEQ ID NO: 3937 - protein, 12 aa, Homo sapiens
VGRATPPPGIMA

SEQ ID NO: 3938 - protein, 21 aa, Homo sapiens
VSLVCEEKLCNEKLLKKARIH

SEQ ID NO: 3939 - protein, 13 aa, Homo sapiens
VTKYITKGWKEVH

SEQ ID NO: 3940 - protein, 17 aa, Mus musculus
VVKKGTDFQLNQLEGKK

SEQ ID NO: 3941 - protein, 15 aa, Homo sapiens
YKTGHGLRGKLKWRP

SEQ ID NO: 3942 - protein, 8 aa, Homo sapiens
AAAAAPAK

SEQ ID NO: 3943 - protein, 22 aa, Mus musculus
AGRGRGRGRGRGRGRGRGRGSL

SEQ ID NO: 3944 - protein, 22 aa, Homo sapiens
AKVEAKEESEESDEDMGFGLFD

SEQ ID NO: 3945 - protein, 15 aa, Homo sapiens
ALGGNSSPSAKDIKK

SEQ ID NO: 3946 - protein, 15 aa, Homo sapiens
APAAGSAPAAAEEKK

SEQ ID NO: 3947 - protein, 24 aa, Homo sapiens
AVHGERLHLFCEKDGKALCWVCAQ

SEQ ID NO: 3948 - protein, 16 aa, Homo sapiens
CAFTGPLRPFFSPGFN

SEQ ID NO: 3949 - protein, 15 aa, Homo sapiens
CHSSALELLQEVIIV

SEQ ID NO: 3950 - protein, 15 aa, Homo sapiens
DDRLNKVISELNGKN

SEQ ID NO: 3951 - protein, 15 aa, Homo sapiens
DEKKEESEESDDDMG

SEQ ID NO: 3952 - protein, 8 aa, Homo sapiens
DMGFGLFD

SEQ ID NO: 3953 - protein, 16 aa, Homo sapiens
ECISQVGKGGGSVCAV

SEQ ID NO: 3954 - protein, 24 aa, Homo sapiens
EEVTCPICLDPFVEPVSIECGHSF

SEQ ID NO: 3955 - protein, 15 aa, Homo sapiens
ESEESDDDMGFGLFD

SEQ ID NO: 3956 - protein, 16 aa, Homo sapiens
FHSGKHYWEVDVTGKE

SEQ ID NO: 3957 - protein, 15 aa, unidentified
  REGION 1..15: note = epitope involved in systemic lupus
FIEWNKLRFRQGLEW

SEQ ID NO: 3958 - protein, 13 aa, unidentified
  REGION 1..13: note = epitope involved in systemic lupus
GGGRDRDRDRGGG

SEQ ID NO: 3959 - protein, 8 aa, Homo sapiens
GIARVPLA

SEQ ID NO: 3960 - protein, 15 aa, Homo sapiens
GIEADDDRLNKVISE

SEQ ID NO: 3961 - protein, 16 aa, Homo sapiens
GKALCWVCAQSRKHRD

SEQ ID NO: 3962 - protein, 20 aa, Homo sapiens
GKALCWVCAQSRKHRDHAMV

SEQ ID NO: 3963 - protein, 23 aa, Homo sapiens
GKKKSKPVNKDRYISKMFLRGDS

SEQ ID NO: 3964 - protein, 15 aa, Human Endogenous Retrovirus
GKTCPKEIPKGSKNT

SEQ ID NO: 3965 - protein, 16 aa, Homo sapiens
GLKKMLRTCAVHITLD

SEQ ID NO: 3966 - protein, 11 aa, Homo sapiens
GSIYNPEVLDI

SEQ ID NO: 3967 - protein, 8 aa, Homo sapiens
GVGGPSQQ

SEQ ID NO: 3968 - protein, 8 aa, Homo sapiens
GVGRAAGR

SEQ ID NO: 3969 - protein, 8 aa, Homo sapiens
GVPAGVPI

SEQ ID NO: 3970 - protein, 15 aa, Homo sapiens
IEDVIAQGIGKLASV

SEQ ID NO: 3971 - protein, 17 aa, Homo sapiens
IWLWNKQKYEAGTYPQT

SEQ ID NO: 3972 - protein, 23 aa, Homo sapiens
KAQVAARGRGRGMGRGNIFQKRR

SEQ ID NO: 3973 - protein, 15 aa, Homo sapiens
KDIKKILDSVGIEAD

SEQ ID NO: 3974 - protein, 18 aa, Homo sapiens
KEISQEAREGTQGERCAV

SEQ ID NO: 3975 - protein, 15 aa, Homo sapiens
LNGKNIEDVIAQGIG

SEQ ID NO: 3976 - protein, 16 aa, Homo sapiens
LSEDRRQVRLGDTQQS

SEQ ID NO: 3977 - protein, 13 aa, Homo sapiens
MASAARLTMMWEE

SEQ ID NO: 3978 - protein, 31 aa, Homo sapiens
MLKNAPMLKSMKNKNQGSGAGRGKAAILKAQ

SEQ ID NO: 3979 - protein, 8 aa, Homo sapiens
MMRKAIRG

SEQ ID NO: 3980 - protein, 13 aa, Homo sapiens
MSLLNKPKSEMTP

SEQ ID NO: 3981 - protein, 17 aa, Homo sapiens
NITDHGSLIYSFSECAF

SEQ ID NO: 3982 - protein, 21 aa, Homo sapiens
NSQDGYVWQVTDMNRLHRFLC

SEQ ID NO: 3983 - protein, 15 aa, Homo sapiens
PAGGAVAVSAAPGSA

SEQ ID NO: 3984 - protein, 8 aa, Homo sapiens
PAPGMRPP

SEQ ID NO: 3985 - protein, 18 aa, Mus musculus
PEPAKSAPAPKKGSKKAV

SEQ ID NO: 3986 - protein, 18 aa, Mus musculus
PEPAKSAPAPKKGSKKAV

SEQ ID NO: 3987 - protein, 49 aa, Mus musculus; identical to SEQ ID NO: 3159

SEQ ID NO: 3988 - protein, 7 aa, Homo sapiens
PPGIRGP

SEQ ID NO: 3989 - protein, 8 aa, Homo sapiens
PPPGMIPP

SEQ ID NO: 3990 - protein, 8 aa, Homo sapiens
PPPGMRGP

SEQ ID NO: 3991 - protein, 19 aa, Homo sapiens
PQTPLHLQVPPCQVGIFLD

SEQ ID NO: 3992 - protein, 13 aa, Homo sapiens
QALGITTKISRGT

SEQ ID NO: 3993 - protein, 9 aa, Homo sapiens
QVYIRGSKI

SEQ ID NO: 3994 - protein, 8 aa, Homo sapiens
RATWKSNY

SEQ ID NO: 3995 - protein, 15 aa, Homo sapiens
RDMLLANKVPAAARA

SEQ ID NO: 3996 - protein, 11 aa, Homo sapiens
RDRDRDRDRDR

SEQ ID NO: 3997 - protein, 8 aa, Homo sapiens
RDRDRDRE

SEQ ID NO: 3998 - protein, 8 aa, Homo sapiens
RNPLIAGK

SEQ ID NO: 3999 - protein, 13 aa, Bos taurus
SAPAPKKGSKKAV

SEQ ID NO: 4000 - protein, 17 aa, Homo sapiens
SPGFNDGGKNTAPLTLC

SEQ ID NO: 4001 - protein, 17 aa, Homo sapiens
SQALQELISELDRRCHS

SEQ ID NO: 4002 - protein, 15 aa, Homo sapiens
SSPSAKDIKKILDSV

SEQ ID NO: 4003 - protein, 12 aa, Homo sapiens
SVLTQSVKNNTQ

SEQ ID NO: 4004 - protein, 15 aa, Homo sapiens
SVSYDDWDYSLEARV

SEQ ID NO: 4005 - protein, 14 aa, Homo sapiens
TGEVYRGKLIEAED

SEQ ID NO: 4006 - protein, 15 aa, Homo sapiens
VAVSAAPGSAAPAAG

SEQ ID NO: 4007 - protein, 15 aa, Homo sapiens [sequence omitted]

SEQ ID NO: 4008 - protein, 16 aa, Homo sapiens
VHGERLHLFCEKDGKA

SEQ ID NO: 4009 - protein, 11 aa, Homo sapiens
WTEVPKSGKGK

SEQ ID NO: 4010 - protein, 17 aa, Homo sapiens
YQEKLQVALGELRRKQE

SEQ ID NO: 4011 - protein, 14 aa, Homo sapiens
AETREERMERKRRE

SEQ ID NO: 4012 - protein, 9 aa, Homo sapiens
AFQQGKIPP

SEQ ID NO: 4013 - protein, 22 aa, Homo sapiens
AKGKPDAAKKGVVKAEKSKKKK

SEQ ID NO: 4014 - protein, 20 aa, Homo sapiens
EEASGSSVTAEEAKKFLAPK

SEQ ID NO: 4015 - protein, 8 aa, Homo sapiens
GMMPAPHM

SEQ ID NO: 4016 - protein, 9 aa, Homo sapiens
GPAPGMRPP

SEQ ID NO: 4017 - protein, 9 aa, Homo sapiens
GPPMMRPPA

SEQ ID NO: 4018 - protein, 10 aa, Homo sapiens
GPPRPGMMPA

SEQ ID NO: 4019 - protein, 8 aa, Homo sapiens
HDSPSVRK

SEQ ID NO: 4020 - protein, 8 aa, Homo sapiens
KDYYQKWM

SEQ ID NO: 4021 - protein, 8 aa, Homo sapiens
KIPPTPFS

SEQ ID NO: 4022 - protein, 30 aa, Homo sapiens
LALVFEAPNQEKVSDYEMKLMDLDVEQLGI

SEQ ID NO: 4023 - protein, 7 aa, Homo sapiens
MERKRRE

SEQ ID NO: 4024 - protein, 8 aa, Homo sapiens
PFSAPPPA

SEQ ID NO: 4025 - protein, 7 aa, Human herpesvirus
PPPGRRP

SEQ ID NO: 4026 - protein, 9 aa, Homo sapiens
PPPPGMMPV

SEQ ID NO: 4027 - protein, 8 aa, Homo sapiens
PPPPSLPG

SEQ ID NO: 4028 - protein, 32 aa, Homo sapiens
RERRRSHRSERERRRDRDRDRDRDREHKRGER

SEQ ID NO: 4029 - protein, 10 aa, Homo sapiens
RKTHCSGRKH

SEQ ID NO: 4030 - protein, 10 aa, Homo sapiens
TRPGMTRPDR

SEQ ID NO: 4031 - protein, 20 aa, Mus musculus
YYCARFLWEPYAMDYWGQGS

SEQ ID NO: 4032 - protein, 34 aa, Homo sapiens
AVAATASIAGAPTQYPPGRGTPPPPVGRATPPPG

SEQ ID NO: 4033 - protein, 13 aa, Homo sapiens
GIMAPPPGMRPPM

SEQ ID NO: 4034 - protein, 22 aa, Homo sapiens
GVGGPSQQVMTPQGRGTVAAAA

SEQ ID NO: 4035 - protein, 11 aa, Homo sapiens
MGPPIGLPPAR

SEQ ID NO: 4036 - protein, 32 aa, Homo sapiens
RGTPIGMPPPGMRPPPPGIRGPPPPGMRPPRP

SEQ ID NO: 4037 - protein, 20 aa, Homo sapiens
EALKKIIEDQQESLNKWKSK

SEQ ID NO: 4038 - protein, 20 aa, Homo sapiens
ETPGQKYKETDLLILFKDDY

SEQ ID NO: 4039 - protein, 20 aa, Homo sapiens
FSNHGEIKWIDFVRGAKEGI

SEQ ID NO: 4040 - protein, 6 aa, Homo sapiens
GLELPE

SEQ ID NO: 4041 - protein, 20 aa, Homo sapiens
HPMLPNYKNFKGTIQELGQN

SEQ ID NO: 4042 - protein, 6 aa, Bos taurus
IRGERA

SEQ ID NO: 4043 - protein, 4 aa, Homo sapiens
KIRY

SEQ ID NO: 4044 - protein, 4 aa, Homo sapiens
KKIK

SEQ ID NO: 4045 - protein, 4 aa, Homo sapiens
KNDK

SEQ ID NO: 4046 - protein, 4 aa, Homo sapiens
LDKK

SEQ ID NO: 4047 - protein, 20 aa, Homo sapiens
LILFKDDYFAKKNEERKQNK

SEQ ID NO: 4048 - protein, 12 aa, Homo sapiens
NGNLQLRNKEVT

SEQ ID NO: 4049 - protein, 5 aa, Homo sapiens
PIVET

SEQ ID NO: 4050 - protein, 7 aa, Homo sapiens
QFIGYPI

SEQ ID NO: 4051 - protein, 20 aa, Homo sapiens
SDYKSAHKGFKGVDAQGTLS

SEQ ID NO: 4052 - protein, 5 aa, Homo sapiens
SKEQV

SEQ ID NO: 4053 - protein, 20 aa, Homo sapiens
VRGAKEGIILFKEKAKEALG

SEQ ID NO: 4054 - protein, 10 aa, Homo sapiens
EWEDTYGIVL

SEQ ID NO: 4055 - protein, 10 aa, Staphylococcus aureus
EWESTYSILG

SEQ ID NO: 4056 - protein, 50 aa, Homo sapiens; identical to SEQ ID NO: 3165

SEQ ID NO: 4057 - protein, 23 aa, Homo sapiens
KMLKNREPVQLETLSIRGNRIRY

SEQ ID NO: 4058 - protein, 10 aa, Human herpesvirus
LWDQTYGVPD

SEQ ID NO: 4059 - protein, 25 aa, Homo sapiens
PAVPETLKKKRRNFAELKIKRLRKK

SEQ ID NO: 4060 - protein, 19 aa, Homo sapiens
RMARMARKAGNFYVPAEPK

SEQ ID NO: 4061 - protein, 10 aa, Human immunodeficiency virus
TWNDTYGSNN

SEQ ID NO: 4062 - protein, 10 aa, Homo sapiens
TYGIVLLSGV

SEQ ID NO: 4063 - protein, 14 aa, Bos taurus
ALQEACEAYLVGLF

SEQ ID NO: 4064 - protein, 11 aa, Trypanosoma cruzi
EDDDMGFGLFD

SEQ ID NO: 4065 - protein, 21 aa, Homo sapiens
GGGGGGSGGGGSGGGGGGGSS

SEQ ID NO: 4066 - protein, 18 aa, Bos taurus
RFQSSAVMALQEACEAYL

SEQ ID NO: 4067 - protein, 11 aa, Homo sapiens
TFIQFKKDLKE

SEQ ID NO: 4068 - protein, 21 aa, Bos taurus
ARTKQTARKSTGGKAPRKQLA

SEQ ID NO: 4069 - protein, 16 aa, Bos taurus
AVTYTEHAKRKTVTAM

SEQ ID NO: 4070 - protein, 18 aa, Bos taurus
GAGAPVYLAAVLEYLTAE

SEQ ID NO: 4071 - protein, 7 aa, Escherichia coli
ILPPPGY

SEQ ID NO: 4072 - protein, 20 aa, Bos taurus
IQTAVRLLLPGELAKHAVSE

SEQ ID NO: 4073 - protein, 15 aa, Bos taurus
KQLATKAARKSAPAT

SEQ ID NO: 4074 - protein, 21 aa, Bos taurus
LAGNAARDNKKTRIIPRHLQL

SEQ ID NO: 4075 - protein, 16 aa, Bos taurus
LAIRNDEELNKLLGKV

SEQ ID NO: 4076 - protein, 14 aa, Bos taurus
LPKKTESHHKAKGK

SEQ ID NO: 4077 - protein, 15 aa, Bos taurus
MSGRGKQGGKARAKA

SEQ ID NO: 4078 - protein, 16 aa, Bos taurus
PATGGVKKPHRYRPGT

SEQ ID NO: 4079 - protein, 16 aa, Bos taurus
RYRPGTVALREIRRYQ

SEQ ID NO: 4080 - protein, 7 aa, Mus musculus
SPLNVLM

SEQ ID NO: 4081 - protein, 7 aa, Human herpesvirus
SPPEWLK

SEQ ID NO: 4082 - protein, 16 aa, Bos taurus
VHPDTGISSKAMGIMN

SEQ ID NO: 4083 - protein, 15 aa, Bos taurus
VSEGTKAVTKYTSSK

SEQ ID NO: 4084 - protein, 8 aa, Homo sapiens
ADGKKIDG

SEQ ID NO: 4085 - protein, 8 aa, Homo sapiens
AIALREYR

SEQ ID NO: 4086 - protein, 8 aa, Homo sapiens
AICSQCSD

SEQ ID NO: 4087 - protein, 8 aa, unidentified
  REGION 1..8: note = epitope involved in systemic lupus
AKAKAKAK

SEQ ID NO: 4088 - protein, 16 aa, Homo sapiens
ALAVTKYKQRNGWSHK

SEQ ID NO: 4089 - protein, 8 aa, Homo sapiens
ALFAPRDP

SEQ ID NO: 4090 - protein, 10 aa, Homo sapiens
ASAARLTMMW

SEQ ID NO: 4091 - protein, 11 aa, Homo sapiens
AVEKVKRTKDE

SEQ ID NO: 4092 - protein, 16 aa, Homo sapiens
DVEPKVKSKKREAVAG

SEQ ID NO: 4093 - protein, 22 aa, Homo sapiens
EKDSYVVAFSDEMVPCPVTTDM

SEQ ID NO: 4094 - protein, 10 aa, Homo sapiens
ERMERKRREK

SEQ ID NO: 4095 - protein, 15 aa, Homo sapiens
FTFIQFKKDLKESMK

SEQ ID NO: 4096 - protein, 8 aa, Homo sapiens
GTQVHGTI

SEQ ID NO: 4097 - protein, 8 aa, Homo sapiens
HPAIALRE

SEQ ID NO: 4098 - protein, 8 aa, Homo sapiens
IALREYRK

SEQ ID NO: 4099 - protein, 8 aa, Homo sapiens
ILPDSLPL

SEQ ID NO: 4100 - protein, 15 aa, Homo sapiens
KDKDRDRKRRSSRSR

SEQ ID NO: 4101 - protein, 8 aa, unidentified
  REGION 1..8: note = epitope involved in systemic lupus
KKAKAKAK

SEQ ID NO: 4102 - protein, 15 aa, Homo sapiens
KKAPAKKGEKVPKGK

SEQ ID NO: 4103 - protein, 4 aa, unidentified
  REGION 1..4: note = epitope involved in systemic lupus
KKKK

SEQ ID NO: 4104 - protein, 16 aa, Homo sapiens
LCNEKLLKKARIHPFH

SEQ ID NO: 4105 - protein, 16 aa, Homo sapiens
LFKPPKYHPDVPYVKR

SEQ ID NO: 4106 - protein, 8 aa, Homo sapiens
LLVDVEPK

SEQ ID NO: 4107 - protein, 12 aa, Homo sapiens
LPMIWAQKTNTP

SEQ ID NO: 4108 - protein, 15 aa, Homo sapiens
LRKFKNISYFPGKLR

SEQ ID NO: 4109 - protein, 8 aa, Homo sapiens
LTALLRNL

SEQ ID NO: 4110 - protein, 22 aa, Homo sapiens
MEESVNQMQPLNEKQIANSQDG

SEQ ID NO: 4111 - protein, 8 aa, Homo sapiens
MPLTALLR

SEQ ID NO: 4112 - protein, 14 aa, Homo sapiens
NTHLKAVKMTLKNR

SEQ ID NO: 4113 - protein, 8 aa, Homo sapiens
PAIALREY

SEQ ID NO: 4114 - protein, 8 aa, Homo sapiens
PLTALLRN

SEQ ID NO: 4115 - protein, 15 aa, Homo sapiens
QRRSARLSAKPAPPK

SEQ ID NO: 4116 - protein, 8 aa, unidentified
  REGION 1..8: note = epitope involved in systemic lupus
RARARARA

SEQ ID NO: 4117 - protein, 28 aa, Homo sapiens
REAVAGRGRGRGRGRGRGRGRGRGGPRR

SEQ ID NO: 4118 - protein, 8 aa, Homo sapiens
RFLMKLSH

SEQ ID NO: 4119 - protein, 8 aa, unidentified
  REGION 1..8: note = epitope involved in systemic lupus
RRARARAR

SEQ ID NO: 4120 - protein, 4 aa, unidentified
  REGION 1..4: note = epitope involved in systemic lupus
RRRR

SEQ ID NO: 4121 - protein, 8 aa, Homo sapiens
RRRSRERS

SEQ ID NO: 4122 - protein, 8 aa, Homo sapiens
RRSHRSER

SEQ ID NO: 4123 - protein, 8 aa, Homo sapiens
RRSRSRDK

SEQ ID NO: 4124 - protein, 8 aa, Homo sapiens
SEGLAIVT

SEQ ID NO: 4125 - protein, 17 aa, Homo sapiens
SKLIKIFQDHPLQKTYN

SEQ ID NO: 4126 - protein, 8 aa, Homo sapiens
SRERSKDK

SEQ ID NO: 4127 - protein, 8 aa, Homo sapiens
TALLRNLG

SEQ ID NO: 4128 - protein, 8 aa, Homo sapiens
TLKNREPV

SEQ ID NO: 4129 - protein, 16 aa, Homo sapiens
TYKTGHGLRGKLKWRP

SEQ ID NO: 4130 - protein, 8 aa, Homo sapiens
VERGRTVK

SEQ ID NO: 4131 - protein, 8 aa, Homo sapiens
VHPAIALR

SEQ ID NO: 4132 - protein, 8 aa, Homo sapiens
VKGWRPRR

SEQ ID NO: 4133 - protein, 12 aa, Homo sapiens
VYSKRSGKPRGY

SEQ ID NO: 4134 - protein, 15 aa, Homo sapiens
YKHADGKKIDGRRVL

SEQ ID NO: 4135 - protein, 15 aa, Mus musculus
AKSAPAPKKGSKKAV

SEQ ID NO: 4136 - protein, 15 aa, Mus musculus
APAPKKGSKKAVTKA

SEQ ID NO: 4137 - protein, 15 aa, Bos taurus
AYLVGLFEDTNLCAI

SEQ ID NO: 4138 - protein, 15 aa, Mus musculus
DGKKRKRSRKESYSV

SEQ ID NO: 4139 - protein, 15 aa, Homo sapiens
FLENVIRDAVTYTEH

SEQ ID NO: 4140 - protein, 15 aa, Mus musculus
GGAKRHRKVLRDNIQ

SEQ ID NO: 4141 - protein, 15 aa, Mus musculus
GITKPAIRRIARRGG

SEQ ID NO: 4142 - protein, 15 aa, Homo sapiens
GKGGKGLGKGGAKRH

SEQ ID NO: 4143 - protein, 15 aa, Mus musculus
GKGLGKGGAKRHRKV

SEQ ID NO: 4144 - protein, 15 aa, Mus musculus
IMMSFVNDIFERIAG

SEQ ID NO: 4145 - protein, 15 aa, Mus musculus
IRRIARRGGVKRISG

SEQ ID NO: 4146 - protein, 15 aa, Mus musculus
ISGLIYEETRGVLKV

SEQ ID NO: 4147 - protein, 15 aa, Mus musculus
KPAIRRIARRGGVKR

SEQ ID NO: 4148 - protein, 24 aa, Mus musculus
KRHRKVLRDNIQGITKPAIRRIAR

SEQ ID NO: 4149 - protein, 15 aa, Mus musculus
LGKGGAKRHRKVLRD

SEQ ID NO: 4150 - protein, 15 aa, Mus musculus
LKVFLENVIRDAVTY

SEQ ID NO: 4151 - protein, 15 aa, Mus musculus
NDIFERIAGEASRLA

SEQ ID NO: 4152 - protein, 15 aa, Homo sapiens
NVIRDAVTYTEHAKR

SEQ ID NO: 4153 - protein, 15 aa, Mus musculus
PEPAKSAPAPKKGSK

SEQ ID NO: 4154 - protein, 24 aa, Mus musculus
PKKGSKKAVTKAQKKDGKKRKRSR

SEQ ID NO: 4155 - protein, 15 aa, Mus musculus
QKKDGKKRKRSRKES

SEQ ID NO: 4156 - protein, 15 aa, Mus musculus
RDAVTYTEHAKRKTV

SEQ ID NO: 4157 - protein, 15 aa, Mus musculus
RGVLKVFLENVIRDA

SEQ ID NO: 4158 - protein, 15 aa, Homo sapiens
SGRGKGGKGLGKGGA

SEQ ID NO: 4159 - protein, 15 aa, Mus musculus
SREIQTAVRLLLPGE

SEQ ID NO: 4160 - protein, 15 aa, Homo sapiens
YALKRQGRTLYGFGG

SEQ ID NO: 4161 - protein, 10 aa, Homo sapiens
AAFQQGKIPP

SEQ ID NO: 4162 - protein, 8 aa, Homo sapiens
AMPPQQLM

SEQ ID NO: 4163 - protein, 10 aa, Homo sapiens
APGMRPPMGG

SEQ ID NO: 4164 - protein, 8 aa, Homo sapiens
ATKKAVQG

SEQ ID NO: 4165 - protein, 8 aa, Homo sapiens
EVRLVPGR

SEQ ID NO: 4166 - protein, 10 aa, Homo sapiens
FQQGKIPPTP

SEQ ID NO: 4167 - protein, 8 aa, Homo sapiens
GAMPPQQL

SEQ ID NO: 4168 - protein, 8 aa, Homo sapiens
GMIPPPGL

SEQ ID NO: 4169 - protein, 8 aa, Homo sapiens
GMPPMTQA

SEQ ID NO: 4170 - protein, 10 aa, Homo sapiens
GPAPGMRPPM

SEQ ID NO: 4171 - protein, 8 aa, Homo sapiens
GQPPYMPP

SEQ ID NO: 4172 - protein, 8 aa, Homo sapiens
IGTFKAFD

SEQ ID NO: 4173 - protein, 8 aa, Homo sapiens
IPPGAMPP

SEQ ID NO: 4174 - protein, 8 aa, Homo sapiens
IPPPGLAP

SEQ ID NO: 4175 - protein, 8 aa, Homo sapiens
KPKSQETP

SEQ ID NO: 4176 - protein, 8 aa, Homo sapiens
MIPPPGLA

SEQ ID NO: 4177 - protein, 8 aa, Homo sapiens
MPPMTQAP

SEQ ID NO: 4178 - protein, 8 aa, Homo sapiens
MPPPGMIP

SEQ ID NO: 4179 - protein, 8 aa, Homo sapiens
MPPQQLMP

SEQ ID NO: 4180 - protein, 8 aa, Homo sapiens
MTQAPRIM

SEQ ID NO: 4181 - protein, 8 aa, Homo sapiens
PATKKAVQ

SEQ ID NO: 4182 - protein, 8 aa, Homo sapiens
PGAMPPQQ

SEQ ID NO: 4183 - protein, 8 aa, Homo sapiens
PGMIPPPG

SEQ ID NO: 4184 - protein, 8 aa, Homo sapiens
PMTQAPRI

SEQ ID NO: 4185 - protein, 8 aa, Homo sapiens
PPAQPLSE

SEQ ID NO: 4186 - protein, 8 aa, Homo sapiens
PPGAMPPQ

SEQ ID NO: 4187 - protein, 8 aa, Homo sapiens
PPGMIPPP

SEQ ID NO: 4188 - protein, 8 aa, Homo sapiens
PPMTQAPR

SEQ ID NO: 4189 - protein, 8 aa, Homo sapiens
PPPGLAPG

SEQ ID NO: 4190 - protein, 8 aa, Homo sapiens
PPQQLMPG

SEQ ID NO: 4191 - protein, 8 aa, Homo sapiens
PPYMPPPG

SEQ ID NO: 4192 - protein, 10 aa, Homo sapiens
PVGPAPGMRP

SEQ ID NO: 4193 - protein, 8 aa, Homo sapiens
PYMPPPGM

SEQ ID NO: 4194 - protein, 8 aa, Homo sapiens
QPPYMPPP

SEQ ID NO: 4195 - protein, 8 aa, Homo sapiens
RGVGGPSQ

SEQ ID NO: 4196 - protein, 8 aa, Homo sapiens
TPATKKAV

SEQ ID NO: 4197 - protein, 8 aa, Homo sapiens
YMPPPGMI

SEQ ID NO: 4198 - protein, 40 aa, Homo sapiens
RREFEVYGPIKRIHMVYSKRSGKPRGYAFIEYEHERDMHS

SEQ ID NO: 4199 - protein, 17 aa, Homo sapiens
KILGNQGSFLTKGPSKL

SEQ ID NO: 4200 - protein, 12 aa, Homo sapiens
TYICEVEDQKEE

SEQ ID NO: 4201 - protein, 18 aa, Homo sapiens
AEIETDKATIGFEVQEEG

SEQ ID NO: 4202 - protein, 15 aa, Homo sapiens
GLKKMLRTCAVHITL

SEQ ID NO: 4203 - protein, 18 aa, Homo sapiens
SAPATGGVKKPHRYRPGT

SEQ ID NO: 4204 - protein, 15 aa, Homo sapiens
AGAGRVRTSARAGST

SEQ ID NO: 4205 - protein, 15 aa, Homo sapiens
APAPRTRYPTRAPSG

SEQ ID NO: 4206 - protein, 15 aa, Homo sapiens
ATARRKRRWATRGPA

SEQ ID NO: 4207 - protein, 15 aa, Torque teno virus
AVLRAPQNPPPPGPQ

SEQ ID NO: 4208 - protein, 15 aa, Homo sapiens
CAGWALWRCALRWAE

SEQ ID NO: 4209 - protein, 15 aa, Torque teno virus
DEYKRFMNYWTASNE

SEQ ID NO: 4210 - protein, 15 aa, Human herpesvirus
DPVGHPAAPRAPGPE

SEQ ID NO: 4211 - protein, 15 aa, Torque teno virus
DRGEGNMLWIDWLSK

SEQ ID NO: 4212 - protein, 15 aa, Homo sapiens
DRRREGPDRSPRQPP

SEQ ID NO: 4213 - protein, 15 aa, Homo sapiens
GPDRSPRQPPVLPAA

SEQ ID NO: 4214 - protein, 15 aa, Homo sapiens
GPGAGDRRREGPDRS

SEQ ID NO: 4215 - protein, 15 aa, Homo sapiens
HPAFARAHGEAGAGR

SEQ ID NO: 4216 - protein, 15 aa, Homo sapiens
HRALARGPPARLGGE

SEQ ID NO: 4217 - protein, 15 aa, Homo sapiens
KRRWATRGPAHPAFA

SEQ ID NO: 4218 - protein, 15 aa, Homo sapiens
LRWAERQVGALGAES

SEQ ID NO: 4219 - protein, 15 aa, Homo sapiens
LWRCALRWAERQVGA

SEQ ID NO: 4220 - protein, 15 aa, Homo sapiens
PQDPRSPGPAPRHRR

SEQ ID NO: 4221 - protein, 15 aa, Homo sapiens
PRAPPARASYRRFRT

SEQ ID NO: 4222 - protein, 15 aa, Human herpesvirus
PRHGHSQGPWKPWSA

SEQ ID NO: 4223 - protein, 15 aa, Homo sapiens
PRHRHPQDPRSPGPA

SEQ ID NO: 4224 - protein, 15 aa, Homo sapiens
PRHRRPPRPDPRAPP

SEQ ID NO: 4225 - protein, 15 aa, Torque teno virus
PRSRHPGGPGTPQIR

SEQ ID NO: 4226 - protein, 15 aa, Human adenovirus
PSRRRRRRKATLAPA

SEQ ID NO: 4227 - protein, 15 aa, Homo sapiens
RAHGEAGAGRVRTSA

SEQ ID NO: 4228 - protein, 15 aa, Homo sapiens
RAPSGPRPPSRSQAQ

SEQ ID NO: 4229 - protein, 15 aa, Homo sapiens
RLGGEGPGAGDRRRE

SEQ ID NO: 4230 - protein, 15 aa, Homo sapiens
RLSPGHRALARGPPA

SEQ ID NO: 4231 - protein, 15 aa, Human herpesvirus
RVPRIPRDPRPPRPP

SEQ ID NO: 4232 - protein, 15 aa, Homo sapiens
SPGPAPRHRRPPRPD

SEQ ID NO: 4233 - protein, 15 aa, Homo sapiens
SWERRRLSPGHRALA

SEQ ID NO: 4234 - protein, 15 aa, Homo sapiens
TLRPAATARRKRRWA

SEQ ID NO: 4235 - protein, 15 aa, Homo sapiens
TPPRSVPRLRPRHRH

SEQ ID NO: 4236 - protein, 15 aa, Homo sapiens
TRGPAHPAFARAHGE

SEQ ID NO: 4237 - protein, 15 aa, Human herpesvirus
VASRPLFPPRSPGPS

SEQ ID NO: 4238 - protein, 15 aa, Homo sapiens
VPRLRPRHRHPQDPR

SEQ ID NO: 4239 - protein, 15 aa, Torque teno virus
WWARRRRRWRRWKRR

SEQ ID NO: 4240 - protein, 15 aa, Sus scrofa
AKKGEKVPKGKKGKA

SEQ ID NO: 4241 - protein, 15 aa, Sus scrofa
AKPAPPKPEPKPKKA

SEQ ID NO: 4242 - protein, 15 aa, Sus scrofa
ARLSAKPAPPKPEPK

SEQ ID NO: 4243 - protein, 15 aa, Sus scrofa
EKVPKGKKGKADAGK

SEQ ID NO: 4244 - protein, 15 aa, Sus scrofa
EPKPKKAPAKKGEKV

SEQ ID NO: 4245 - protein, 14 aa, Human herpesvirus
GRGRGRGRGRGGRG

SEQ ID NO: 4246 - protein, 14 aa, Homo sapiens
IKKVATPKKASPKK

SEQ ID NO: 4247 - protein, 15 aa, Sus scrofa
KDEPQRRSARLSAKP

SEQ ID NO: 4248 - protein, 15 aa, Homo sapiens
KSPKKAKAAKPKKAP

SEQ ID NO: 4249 - protein, 15 aa, unidentified
  REGION 1..15: note = epitope involved in systemic lupus
KTPKKAKKPKTPKKA

SEQ ID NO: 4250 - protein, 15 aa, Homo sapiens
PKKSAKKTPKKAKKP

SEQ ID NO: 4251 - protein, 15 aa, Sus scrofa
PKRKAEGDAKGDKAK

SEQ ID NO: 4252 - protein, 15 aa, Sus scrofa
PPKPEPKPKKAPAKK

SEQ ID NO: 4253 - protein, 16 aa, Homo sapiens
AAAGYDVEKNNSRIKL

SEQ ID NO: 4254 - protein, 15 aa, Homo sapiens
AAAPAEEKKVEAKKE

SEQ ID NO: 4255 - protein, 15 aa, Homo sapiens
AAAPVAAATTAAPAA

SEQ ID NO: 4256 - protein, 16 aa, Homo sapiens
AAKPKTAKPKAAKPKK

SEQ ID NO: 4257 - protein, 15 aa, Homo sapiens
AAPAKVEAKEESEES

SEQ ID NO: 4258 - protein, 15 aa, Homo sapiens
AEEKKVEAKKEESEE

SEQ ID NO: 4259 - protein, 8 aa, Homo sapiens
AFDKHMNL

SEQ ID NO: 4260 - protein, 16 aa, Homo sapiens
AGAAKRKASGPPVSEL

SEQ ID NO: 4261 - protein, 15 aa, Homo sapiens
AGGPAPAAGAAPAGG

SEQ ID NO: 4262 - protein, 16 aa, Homo sapiens
AKKAGAAKAKKPAGAA

SEQ ID NO: 4263 - protein, 8 aa, Homo sapiens
ALLRNLGK

SEQ ID NO: 4264 - protein, 8 aa, Homo sapiens
ALREYRKK

SEQ ID NO: 4265 - protein, 15 aa, Homo sapiens
APAAGAAPAGGPAPS

SEQ ID NO: 4266 - protein, 16 aa, Homo sapiens
APKSPAKAKAVKPKAA

SEQ ID NO: 4267 - protein, 15 aa, Homo sapiens
APSTAAAPAEEKKVE

SEQ ID NO: 4268 - protein, 16 aa, Homo sapiens
ATPKKSAKKTPKKAKK

SEQ ID NO: 4269 - protein, 8 aa, Homo sapiens
ATPPPGIM

SEQ ID NO: 4270 - protein, 8 aa, Homo sapiens
CDEFRKIK

SEQ ID NO: 4271 - protein, 15 aa, Homo sapiens
CNVGAGGPAPAAGAA

SEQ ID NO: 4272 - protein, 15 aa, Homo sapiens
DNVGSKQMQQIRMSL

SEQ ID NO: 4273 - protein, 15 aa, Homo sapiens
DRATWKSNYFLKIIQ

SEQ ID NO: 4274 - protein, 15 aa, Homo sapiens
DRLNKVISELNGKNI

SEQ ID NO: 4275 - protein, 15 aa, Homo sapiens
DVQLIKTGDKVGASE

SEQ ID NO: 4276 - protein, 15 aa, Homo sapiens
EADDDRLNKVISELN

SEQ ID NO: 4277 - protein, 15 aa, Homo sapiens
EDKINALIKAAGVNV

SEQ ID NO: 4278 - protein, 8 aa, Homo sapiens
EGPPPKDT

SEQ ID NO: 4279 - protein, 15 aa, Homo sapiens
EILSDVQLIKTGDKV

SEQ ID NO: 4280 - protein, 15 aa, Homo sapiens
EKKEESEESDDDMGF

SEQ ID NO: 4281 - protein, 16 aa, Homo sapiens
EKTPVKKKARKSAGAA

SEQ ID NO: 4282 - protein, 15 aa, Homo sapiens
EKTSFFQALGITTKI

SEQ ID NO: 4283 - protein, 15 aa, Homo sapiens
ELNGKNIEDVIAQGI

SEQ ID NO: 4284 - protein, 15 aa, Homo sapiens
ESEESDEDMGFGLFD

SEQ ID NO: 4285 - protein, 8 aa, Homo sapiens
EYRKKMDI

SEQ ID NO: 4286 - protein, 15 aa, Homo sapiens
FFQALGITTKISRGT

SEQ ID NO: 4287 - protein, 8 aa, Homo sapiens
FKAFDKHM

SEQ ID NO: 4288 - protein, 15 aa, Homo sapiens
GAVAVSAAPGSAAPA

SEQ ID NO: 4289 - protein, 15 aa, Homo sapiens
GGNSSPSAKDIKKIL

SEQ ID NO: 4290 - protein, 15 aa, Homo sapiens
GKAVVLMGKNTMMRK

SEQ ID NO: 4291 - protein, 15 aa, Homo sapiens
GLGPEKTSFFQALGI

SEQ ID NO: 4292 - protein, 8 aa, Homo sapiens
GLPPARGT

SEQ ID NO: 4293 - protein, 8 aa, Homo sapiens
GMPPPGMR

SEQ ID NO: 4294 - protein, 8 aa, Homo sapiens
GPPPPGMR

SEQ ID NO: 4295 - protein, 15 aa, Homo sapiens
GSLICNVGAGGPAPA

SEQ ID NO: 4296 - protein, 8 aa, Homo sapiens
GTFKAFDK

SEQ ID NO: 4297 - protein, 8 aa, Homo sapiens
IGLPPARG

SEQ ID NO: 4298 - protein, 16 aa, Homo sapiens
IKLGLKSLVSKGTLVQ

SEQ ID NO: 4299 - protein, 15 aa, Homo sapiens
IKTGDKVGASEATLL

SEQ ID NO: 4300 - protein, 15 aa, Homo sapiens
IQQVFDNGSIYNPEV

SEQ ID NO: 4301 - protein, 8 aa, Homo sapiens
IWAQKTNT

SEQ ID NO: 4302 - protein, 15 aa, Homo sapiens
KAAGVNVEPFWPGLF

SEQ ID NO: 4303 - protein, 8 aa, Homo sapiens
KAFDKHMN

SEQ ID NO: 4304 - protein, 16 aa, Homo sapiens
KAKKPAAAAGAKKAKS

SEQ ID NO: 4305 - protein, 15 aa, Homo sapiens
KEESEESDEDMGFGL

SEQ ID NO: 4306 - protein, 17 aa, Homo sapiens
KEIKKVATPKKASKPKK

SEQ ID NO: 4307 - protein, 15 aa, Homo sapiens
KKEESEESDDDMGFG

SEQ ID NO: 4308 - protein, 16 aa, Homo sapiens
KLNKKAASGEAKPKAK

SEQ ID NO: 4309 - protein, 15 aa, Homo sapiens
KNIEDVIAQGIGKLA

SEQ ID NO: 4310 - protein, 16 aa, Homo sapiens
KSPKKAKAAKPKKAPK

SEQ ID NO: 4311 - protein, 15 aa, Gallus gallus
KSRKASKAKKVKRSK

SEQ ID NO: 4312 - protein, 15 aa, Homo sapiens
KVEAKEESEESDEDM

SEQ ID NO: 4313 - protein, 15 aa, Homo sapiens
KVEAKKEESEESDDD

SEQ ID NO: 4314 - protein, 15 aa, Homo sapiens
LAALGGNSSPSAKDI

SEQ ID NO: 4315 - protein, 15 aa, Homo sapiens
LADPSAFVAAAPVAA

SEQ ID NO: 4316 - protein, 8 aa, Homo sapiens
LPPARGTP

SEQ ID NO: 4317 - protein, 11 aa, Homo sapiens
LQELEKDEREQ

SEQ ID NO: 4318 - protein, 8 aa, Homo sapiens
LREYRKKM

SEQ ID NO: 4319 - protein, 8 aa, Homo sapiens
MAPPPGMR

SEQ ID NO: 4320 - protein, 15 aa, Homo sapiens
MSLRGKAVVLMGKNT

SEQ ID NO: 4321 - protein, 15 aa, Homo sapiens
PAAAAAPAKVEAKEE

SEQ ID NO: 4322 - protein, 16 aa, Homo sapiens
PAGAAKKPKKATGAAT

SEQ ID NO: 4323 - protein, 15 aa, Homo sapiens
PALEKLLPHIRGNVG

SEQ ID NO: 4324 - protein, 8 aa, Homo sapiens
PGRGTPPP

SEQ ID NO: 4325 - protein, 8 aa, Homo sapiens
PPARGTPI

SEQ ID NO: 4326 - protein, 8 aa, Homo sapiens
PPGRGTPP

SEQ ID NO: 4327 - protein, 8 aa, Homo sapiens
PPPGIMAP

SEQ ID NO: 4328 - protein, 8 aa, Homo sapiens
PTQYPPGR

SEQ ID NO: 4329 - protein, 15 aa, Homo sapiens
QQIRMSLRGKAVVLM

SEQ ID NO: 4330 - protein, 8 aa, Homo sapiens
QVMTPQGR

SEQ ID NO: 4331 - protein, 8 aa, Homo sapiens
RATPPPGI

SEQ ID NO: 4332 - protein, 8 aa, Homo sapiens
REYRKKMD

SEQ ID NO: 4333 - protein, 8 aa, Homo sapiens
RGTPPPPV

SEQ ID NO: 4334 - protein, 8 aa, Homo sapiens
RKKMDIPA

SEQ ID NO: 4335 - protein, 8 aa, Homo sapiens
RPPPPGIR

SEQ ID NO: 4336 - protein, 16 aa, Homo sapiens
RSGVSLAALKKALAAA

SEQ ID NO: 4337 - protein, 6 aa, Gallus gallus
SHPTYS

SEQ ID NO: 4338 - protein, 6 aa, Gallus gallus
SHYKVG

SEQ ID NO: 4339 - protein, 16 aa, Gallus gallus
SKPRAKSGARKSPKKK

SEQ ID NO: 4340 - protein, 15 aa, Homo sapiens
SKQMQQIRMSLRGKA

SEQ ID NO: 4341 - protein, 15 aa, Homo sapiens
SPSAKDIKKILDSVG

SEQ ID NO: 4342 - protein, 6 aa, Gallus gallus
SSRQSI

SEQ ID NO: 4343 - protein, 31 aa, Gallus gallus; identical to SEQ ID NO: 3227

SEQ ID NO: 4344 - protein, 8 aa, Homo sapiens
TFKAFDKH

SEQ ID NO: 4345 - protein, 8 aa, Homo sapiens
TPPPGIMA

SEQ ID NO: 4346 - protein, 15 aa, Homo sapiens
TTAAPAAAAAPAKVE

SEQ ID NO: 4347 - protein, 15 aa, Homo sapiens
TVASVPHSIINGYKR

SEQ ID NO: 4348 - protein, 15 aa, Homo sapiens
VKAFLADPSAFVAAA

SEQ ID NO: 4349 - protein, 15 aa, Homo sapiens
VLMGKNTMMRKAIRG

SEQ ID NO: 4350 - protein, 15 aa, Homo sapiens
VNVEPFWPGLFAKAL

SEQ ID NO: 4351 - protein, 8 aa, Homo sapiens
VRGVGGPS

SEQ ID NO: 4352 - protein, 15 aa, Homo sapiens
VSAAPGSAAPAAGSA

SEQ ID NO: 4353 - protein, 16 aa, Homo sapiens
VSELITKAVAASKERS

SEQ ID NO: 4354 - protein, 15 aa, Homo sapiens
VTVTEDKINALIKAA

SEQ ID NO: 4355 - protein, 8 aa, Homo sapiens
YRKKMDIP

SEQ ID NO: 4356 - protein, 14 aa, Homo sapiens
FKEQFLDGDGWTSR

SEQ ID NO: 4357 - protein, 345 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKLPVKKATVVYQGERVKIQEKFKNGMLHGDKVSFFCKNKEKKCSYTEDAQCIDGTIEVPKCFKEHSSLAFWKTDASDVKPC

SEQ ID NO: 4358 - protein, 7 aa, Homo sapiens
APSVTLF

SEQ ID NO: 4359 - protein, 7 aa, Homo sapiens
ATLVCLI

SEQ ID NO: 4360 - protein, 7 aa, Homo sapiens
AWHQQQP

SEQ ID NO: 4361 - protein, 7 aa, Homo sapiens
ERGLRYL

SEQ ID NO: 4362 - protein, 7 aa, Homo sapiens
ERILTIS

SEQ ID NO: 4363 - protein, 7 aa, Homo sapiens
GASVKVT

SEQ ID NO: 4364 - protein, 7 aa, Homo sapiens
GAVTVAW

SEQ ID NO: 4365 - protein, 7 aa, Homo sapiens
GSHTRGD

SEQ ID NO: 4366 - protein, 20 aa, Homo sapiens
IRGNRIRYFILPDSLPLDTI

SEQ ID NO: 4367 - protein, 7 aa, Homo sapiens
LMKINSD

SEQ ID NO: 4368 - protein, 19 aa, Homo sapiens
MKLVRFLMKLSHETVTIEL

SEQ ID NO: 4369 - protein, 7 aa, Homo sapiens
PDRFSGS

SEQ ID NO: 4370 - protein, 20 aa, Homo sapiens
PLDTIRVDVEPKVKSKKREA

SEQ ID NO: 4371 - protein, 7 aa, Homo sapiens
RGYDSYA

SEQ ID NO: 4372 - protein, 7 aa, Homo sapiens
SYLSLTP

SEQ ID NO: 4373 - protein, 7 aa, Homo sapiens
SYSCQVT

SEQ ID NO: 4374 - protein, 20 aa, Homo sapiens
TGVDVSMNTHLKAVKMTLKN

SEQ ID NO: 4375 - protein, 20 aa, Homo sapiens
VTIELKNGTQVHGTITGVDV

SEQ ID NO: 4376 - protein, 7 aa, Homo sapiens
WKAPSSP

SEQ ID NO: 4377 - protein, 7 aa, Homo sapiens
YAASSYL

SEQ ID NO: 4378 - protein, 7 aa, Homo sapiens
YCQTWGS

SEQ ID NO: 4379 - protein, 7 aa, Homo sapiens
YDSYAIA

SEQ ID NO: 4380 - protein, 8 aa, Homo sapiens
EVFISAPR

SEQ ID NO: 4381 - protein, 10 aa, Mus musculus
PAKSAPAPKK

SEQ ID NO: 4382 - protein, 30 aa, Mus musculus
PEPAKSAPAPKKGSKKAVTKAQKKDGKKRK

SEQ ID NO: 4383 - protein, 21 aa, Human T-cell lymphotropic virus
PPPPSSPTHDPPDSDPQIPPP

SEQ ID NO: 4384 - protein, 8 aa, Homo sapiens
PQIVPEPM

SEQ ID NO: 4385 - protein, 21 aa, Homo sapiens
PTRAPSGPRPPSRSQAQTPPR

SEQ ID NO: 4386 - protein, 10 aa, Homo sapiens
DGPPGELGPD

SEQ ID NO: 4387 - protein, 10 aa, Homo sapiens
DKERERRRSR

SEQ ID NO: 4388 - protein, 10 aa, Homo sapiens
EKIERRQQEV

SEQ ID NO: 4389 - protein, 10 aa, Homo sapiens
ENGYLMEAAP

SEQ ID NO: 4390 - protein, 10 aa, Homo sapiens
ERDKERERRR

SEQ ID NO: 4391 - protein, 10 aa, Homo sapiens
ERPGPSPLPH

SEQ ID NO: 4392 - protein, 10 aa, Homo sapiens
ERSRERDKER

SEQ ID NO: 4393 - protein, 10 aa, Homo sapiens
GERGSERGRD

SEQ ID NO: 4394 - protein, 10 aa, Homo sapiens
GGGLGGTRRG

SEQ ID NO: 4395 - protein, 10 aa, Homo sapiens
IERRQQEVET

SEQ ID NO: 4396 - protein, 10 aa, Homo sapiens
KEERRRSRER

SEQ ID NO: 4397 - protein, 8 aa, Homo sapiens
KMKGTFVE

SEQ ID NO: 4398 - protein, 10 aa, Homo sapiens
KRGERGSERG

SEQ ID NO: 4399 - protein, 10 aa, Homo sapiens
MERKRREKIE

SEQ ID NO: 4400 - protein, 10 aa, Homo sapiens
MMPVGPAPGM

SEQ ID NO: 4401 - protein, 10 aa, Homo sapiens
MTQFLPPNLL

SEQ ID NO: 4402 - protein, 10 aa, Homo sapiens
PGMMPVGPAP

SEQ ID NO: 4403 - protein, 10 aa, Homo sapiens
PGPSPLPHRD

SEQ ID NO: 4404 - protein, 10 aa, Homo sapiens
PPGELGPDGP

SEQ ID NO: 4405 - protein, 10 aa, Homo sapiens
PPPGMMPVGP

SEQ ID NO: 4406 - protein, 10 aa, Homo sapiens
PRRLGGGLGG

SEQ ID NO: 4407 - protein, 10 aa, Homo sapiens
PSPLPHRDRD

SEQ ID NO: 4408 - protein, 10 aa, Homo sapiens
REERMERKRR

SEQ ID NO: 4409 - protein, 10 aa, Homo sapiens
RERERRERSR

SEQ ID NO: 4410 - protein, 10 aa, Homo sapiens
RERRERSRER

SEQ ID NO: 4411 - protein, 10 aa, Homo sapiens
RKRREKIERR

SEQ ID NO: 4412 - protein, 10 aa, Homo sapiens
RLGGGLGGTR

SEQ ID NO: 4413 - protein, 10 aa, Homo sapiens
RREKIERRQQ

SEQ ID NO: 4414 - protein, 10 aa, Homo sapiens
RRERSRERDK

SEQ ID NO: 4415 - protein, 10 aa, Homo sapiens
SRERDKERER

SEQ ID NO: 4416 - protein, 10 aa, Homo sapiens
SRYDERPGPS

SEQ ID NO: 4417 - protein, 10 aa, Homo sapiens
YDERPGPSPL

SEQ ID NO: 4418 - protein, 21 aa, Mus musculus
STDHPKYSDMIVAAIQAEKNR

SEQ ID NO: 4419 - protein, 13 aa, Homo sapiens
AEVETDKATVGFE

SEQ ID NO: 4420 - protein, 21 aa, Homo sapiens
GPPPPGMMPVGPAPGMRPPMG

SEQ ID NO: 4421 - protein, 18 aa, Homo sapiens
VGPAPGMRPPMGGHMPMM

SEQ ID NO: 4422 - protein, 14 aa, Gallus gallus
DWMEEEEGAQREKE

SEQ ID NO: 4423 - protein, 8 aa, Homo sapiens
GTLHVVQR

SEQ ID NO: 4424 - protein, 8 aa, Homo sapiens
IIWRSTQG

SEQ ID NO: 4425 - protein, 8 aa, Homo sapiens
IWRSTQGV

SEQ ID NO: 4426 - protein, 8 aa, Homo sapiens
LGTLHVVQ

SEQ ID NO: 4427 - protein, 8 aa, Homo sapiens
RIIWRSTQ

SEQ ID NO: 4428 - protein, 8 aa, Homo sapiens
RVRVSWSP

SEQ ID NO: 4429 - protein, 8 aa, Homo sapiens
RVSWSPVP

SEQ ID NO: 4430 - protein, 21 aa, Gallus gallus
SASHPTYSEMIAAAIRAEKSR

SEQ ID NO: 4431 - protein, 14 aa, Gallus gallus
SQKEEEEGAQREKE

SEQ ID NO: 4432 - protein, 8 aa, Homo sapiens
TLHVVQRG

SEQ ID NO: 4433 - protein, 8 aa, Homo sapiens
VPRAQGFL

SEQ ID NO: 4434 - protein, 8 aa, Homo sapiens
VRVSWSPV

SEQ ID NO: 4435 - protein, 21 aa, Homo sapiens
ECLPQHAMFGNDTITCTTHGN

SEQ ID NO: 4436 - protein, 15 aa, Homo sapiens
KLPVKKATVVYQGER

SEQ ID NO: 4437 - protein, 16 aa, Homo sapiens
LPVKKATVVYQGERVK

SEQ ID NO: 4438 - protein, 14 aa, Homo sapiens
PVKKATVVYQGERV

SEQ ID NO: 4439 - protein, 17 aa, unidentified
  REGION 1..17: note = epitope involved in systemic lupus
APVCVWERLSPYRERCV

SEQ ID NO: 4440 - protein, 17 aa, unidentified
  REGION 1..17: note = epitope involved in systemic lupus
APVCVWERLSPYRERCV

SEQ ID NO: 4441 - protein, 21 aa, unidentified
  REGION 1..21: note = epitope involved in systemic lupus
APVCVWERLSPYRERCVPAEG

SEQ ID NO: 4442 - protein, 18 aa, unidentified
  REGION 1..18: note = epitope involved in systemic lupus
CHWDPFSLSAYFPGGGSC

SEQ ID NO: 4443 - protein, 12 aa, unidentified
  REGION 1..12: note = epitope involved in systemic lupus
HWDPFSLSAYFP

SEQ ID NO: 4444 - protein, 12 aa, unidentified
  REGION 1..12: note = epitope involved in systemic lupus
HWDPFSLSAYFP

SEQ ID NO: 4445 - protein, 16 aa, unidentified
  REGION 1..16: note = epitope involved in systemic lupus
HWDPFSLSAYFPGGGS

SEQ ID NO: 4446 - protein, 22 aa, Mus musculus
SGRGKGGKGLGKGGAKRHRKVL

SEQ ID NO: 4447 - protein, 22 aa, Mus musculus
SGRGKGGKGLGKGGAKRHRKVL

SEQ ID NO: 4448 - protein, 5 aa, unidentified
  REGION 1..5: note = epitope involved in systemic lupus
DWEYS

SEQ ID NO: 4449 - protein, 10 aa, unidentified
  REGION 1..10: note = epitope involved in systemic lupus
DWEYSVWSLN

SEQ ID NO: 4450 - protein, 18 aa, Mus musculus
LPDPYQKQCDDFVAEYEP

SEQ ID NO: 4451 - protein, 21 aa, Mus musculus
KEGYKVRLDLNITLEFRTTSK

SEQ ID NO: 4452 - protein, 15 aa, Homo sapiens
PPGMRPPMGPMGIPP

SEQ ID NO: 4453 - protein, 9 aa, Burkholderia fungorum
RAGTDEGFG

SEQ ID NO: 4454 - protein, 17 aa, Mus musculus
DGKWHTVKTEYIKRKAF

SEQ ID NO: 4455 - protein, 12 aa, Homo sapiens
GARGLTGRPGDA

SEQ ID NO: 4456 - protein, 12 aa, Homo sapiens
GARGLTGRPGDA

SEQ ID NO: 4457 - protein, 19 aa, Mus musculus
GRLHFMFDLGKGRTKVSHP

SEQ ID NO: 4458 - protein, 17 aa, Mus musculus
KATPMLKMRTSFHGCIK

SEQ ID NO: 4459 - protein, 21 aa, Mus musculus
KNLEISRSTFDLLRNSYGVRK

SEQ ID NO: 4460 - protein, 22 aa, Mus musculus
KQNCLSSRASFRGCVRNLRLSR

SEQ ID NO: 4461 - protein, 22 aa, Mus musculus
RPVRHAQCRVCDGNSTNPRERH

SEQ ID NO: 4462 - protein, 19 aa, Mus musculus
TSLRKALLHAPTGSYSDGQ

SEQ ID NO: 4463 - protein, 15 aa, unidentified
  REGION 1..15: note = epitope involved in systemic lupus
DHRSPPWLTSLLTIS

SEQ ID NO: 4464 - protein, 15 aa, unidentified
  REGION 1..15: note = epitope involved in systemic lupus
DTWPTARLTSSMQYI

SEQ ID NO: 4465 - protein, 15 aa, unidentified
  REGION 1..15: note = epitope involved in systemic lupus
GHRYTSSVSLTEACP

SEQ ID NO: 4466 - protein, 15 aa, unidentified
  REGION 1..15: note = epitope involved in systemic lupus
HTYTSHLRYVPPISL

SEQ ID NO: 4467 - protein, 15 aa, unidentified
  REGION 1..15: note = epitope involved in systemic lupus
KLTSSLRCNCPPLRF

SEQ ID NO: 4468 - protein, 15 aa, unidentified
  REGION 1..15: note = epitope involved in systemic lupus
KLTSSLRYNSPPLCF

SEQ ID NO: 4469 - protein, 15 aa, unidentified
  REGION 1..15: note = epitope involved in systemic lupus
KSTSSLRDNSPPVCF

SEQ ID NO: 4470 - protein, 15 aa, unidentified
  REGION 1..15: note = epitope involved in systemic lupus
QAPRLMSSLSYFPQS

SEQ ID NO: 4471 - protein, 15 aa, unidentified
  REGION 1..15: note = epitope involved in systemic lupus
RDGQRLTSSKTMLPY

SEQ ID NO: 4472 - protein, 10 aa, unidentified
  REGION 1..10: note = epitope involved in systemic lupus
RLTSSLRYNP

SEQ ID NO: 4473 - protein, 15 aa, unidentified
  REGION 1..15: note = epitope involved in systemic lupus
RRTPDPAVSPWQLTY

SEQ ID NO: 4474 - protein, 15 aa, unidentified
  REGION 1..15: note = epitope involved in systemic lupus
THDLSSRASSSLSYN

SEQ ID NO: 4475 - protein, 7 aa, Homo sapiens
ATVQLPQ

SEQ ID NO: 4476 - protein, 7 aa, Homo sapiens
QPHSRPY

SEQ ID NO: 4477 - protein, 15 aa, Homo sapiens
ASGFTFSNYAMHWVR

SEQ ID NO: 4478 - protein, 15 aa, Homo sapiens
GLEWVAVISYDGGNK

SEQ ID NO: 4479 - protein, 15 aa, Homo sapiens
KYYADSVKGRFTISR

SEQ ID NO: 4480 - protein, 14 aa, Homo sapiens
MHWVRQAPGKGLEW

SEQ ID NO: 4481 - protein, 14 aa, Homo sapiens
MYWVRQAPGKGLEW

SEQ ID NO: 4482 - protein, 15 aa, Homo sapiens
QAPGKGLEWVAVISY

SEQ ID NO: 4483 - protein, 15 aa, Homo sapiens
VAVISYDGGNKYYAD

SEQ ID NO: 4484 - protein, 13 aa, Homo sapiens
ALREYRKKMDIPA

SEQ ID NO: 4485 - protein, 29 aa, Homo sapiens
GGPPMMPMMGPPPPGMMPVGPAPGMRPPM

SEQ ID NO: 4486 - protein, 31 aa, Homo sapiens
HKENVKDYYQKWMEEQAQSLIDKTTAAFQQG

SEQ ID NO: 4487 - protein, 8 aa, Homo sapiens
APPDDGPP

SEQ ID NO: 4488 - protein, 8 aa, Homo sapiens
CETNTGEV

SEQ ID NO: 4489 - protein, 8 aa, Homo sapiens
EEEEDGEM

SEQ ID NO: 4490 - protein, 8 aa, Homo sapiens
EELQKREE

SEQ ID NO: 4491 - protein, 8 aa, Homo sapiens
EIHSKTKS

SEQ ID NO: 4492 - protein, 8 aa, Homo sapiens
NTEEYIDG

SEQ ID NO: 4493 - protein, 8 aa, Homo sapiens
PDGPDGPE

SEQ ID NO: 4494 - protein, 8 aa, Homo sapiens
WSKAHPPE

SEQ ID NO: 4495 - protein, 24 aa, Homo sapiens
FCPDVEFKRRFKEAFSKAAQQTKG

SEQ ID NO: 4496 - protein, 26 aa, Homo sapiens
FGHISGGHINPAVTVAMVCTRKISIA

SEQ ID NO: 4497 - protein, 22 aa, Homo sapiens
MSDRPTARRWGKCGPLCTRENI

SEQ ID NO: 4498 - protein, 6 aa, Homo sapiens
PPPGIR

SEQ ID NO: 4499 - protein, 6 aa, Homo sapiens
PPPGMR

SEQ ID NO: 4500 - protein, 4 aa, Homo sapiens
PQGR

SEQ ID NO: 4501 - protein, 18 aa, Homo sapiens
PESFDGDPASNTAPLQPE

SEQ ID NO: 4502 - protein, 17 aa, Homo sapiens
KIHAREIFDSRGNPTVE

SEQ ID NO: 4503 - protein, 8 aa, Homo sapiens
PDDLPFST

SEQ ID NO: 4504 - protein, 13 aa, Homo sapiens
GRPGRRGRPGLKG

SEQ ID NO: 4505 - protein, 13 aa, Homo sapiens
PGKVGPKGPMGPK

SEQ ID NO: 4506 - protein, 13 aa, Homo sapiens
YNQYSQRYHQRTN

SEQ ID NO: 4507 - protein, 15 aa, Homo sapiens
ADSASSSESERNITI

SEQ ID NO: 4508 - protein, 15 aa, Homo sapiens
AKATKDVERNLSRDL

SEQ ID NO: 4509 - protein, 15 aa, Homo sapiens
DDKKKKEAAQKKATE

SEQ ID NO: 4510 - protein, 15 aa, Homo sapiens
DGLRNSTGLGSQNKF

SEQ ID NO: 4511 - protein, 15 aa, Homo sapiens
DVERNLSRDLVQEEE

SEQ ID NO: 4512 - protein, 15 aa, Homo sapiens
HYENSQRGPVSSTSD

SEQ ID NO: 4513 - protein, 15 aa, Homo sapiens
KEAAQKKATEQKIKV

SEQ ID NO: 4514 - protein, 15 aa, Homo sapiens
KKATEQKIKVPEQIK

SEQ ID NO: 4515 - protein, 15 aa, Homo sapiens
KKKKKDDKKKKEAAQ

SEQ ID NO: 4516 - protein, 15 aa, Homo sapiens
KNAVVSDLSEKEAWP

SEQ ID NO: 4517 - protein, 15 aa, Homo sapiens
KQLLKRGQHFPVIAA

SEQ ID NO: 4518 - protein, 15 aa, Homo sapiens
KRATANNQQPQQQQQ

SEQ ID NO: 4519 - protein, 15 aa, Homo sapiens
LSRDLVQEEEQLMEE

SEQ ID NO: 4520 - protein, 15 aa, Homo sapiens
MRELEAKATKDVERN

SEQ ID NO: 4521 - protein, 15 aa, Homo sapiens
NLGSAVKVLNSQSES

SEQ ID NO: 4522 - protein, 15 aa, Homo sapiens
NNQQPQQQQQQQQPQ

SEQ ID NO: 4523 - protein, 15 aa, Homo sapiens
NSKNQSDINHSTSGS

SEQ ID NO: 4524 - protein, 15 aa, Homo sapiens
PQALPRYPREVPPRF

SEQ ID NO: 4525 - protein, 15 aa, Homo sapiens
PVIAANLGSAVKVLN

SEQ ID NO: 4526 - protein, 15 aa, Homo sapiens
QKIKVPEQIKPSVSQ

SEQ ID NO: 4527 - protein, 15 aa, Homo sapiens
QLMEEKKKKKDDKKK

SEQ ID NO: 4528 - protein, 15 aa, Homo sapiens
QPQQQPQALPRYPRE

SEQ ID NO: 4529 - protein, 15 aa, Homo sapiens
QPQQQQPQQQPQALP

SEQ ID NO: 4530 - protein, 15 aa, Homo sapiens
QQPQPQPQQQQPQQQ

SEQ ID NO: 4531 - protein, 15 aa, Homo sapiens
QQQPQQQPQPQPQQQ

SEQ ID NO: 4532 - protein, 15 aa, Homo sapiens
QQQPQQQQPQQQPQP

SEQ ID NO: 4533 - protein, 15 aa, Homo sapiens
QQQQQQQQPQQQQPQ

SEQ ID NO: 4534 - protein, 15 aa, Homo sapiens
QRGPVSSTSDSSTNC

SEQ ID NO: 4535 - protein, 15 aa, Homo sapiens
RHQEHKQLLKRGQHF

SEQ ID NO: 4536 - protein, 15 aa, Homo sapiens
RNITIMASGNTGGEK

SEQ ID NO: 4537 - protein, 15 aa, Homo sapiens
RYPREVPPRFRHQEH

SEQ ID NO: 4538 - protein, 15 aa, Homo sapiens
SALTNQQPQNNGEVQ

SEQ ID NO: 4539 - protein, 15 aa, Homo sapiens
SDINHSTSGSHYENS

SEQ ID NO: 4540 - protein, 15 aa, Homo sapiens
SNNGTSTATSTNNNA

SEQ ID NO: 4541 - protein, 15 aa, Homo sapiens
SSTSDSSTNCKNAVV

SEQ ID NO: 4542 - protein, 15 aa, Homo sapiens
STATSTNNNAKRATA

SEQ ID NO: 4543 - protein, 15 aa, Homo sapiens
STGLGSQNKFVVGSS

SEQ ID NO: 4544 - protein, 15 aa, Homo sapiens
TNNNAKRATANNQQP

SEQ ID NO: 4545 - protein, 15 aa, Homo sapiens
VKVLNSQSESSALTN

SEQ ID NO: 4546 - protein, 15 aa, Homo sapiens
VPPRFRHQEHKQLLK

SEQ ID NO: 4547 - protein, 15 aa, Homo sapiens
VQEEEQLMEEKKKKK

SEQ ID NO: 4548 - protein, 15 aa, Homo sapiens
KLTSEARGRIPVAQK

SEQ ID NO: 4549 - protein, 19 aa, Homo sapiens
ALMRGKSTEEARKELQAAG

SEQ ID NO: 4550 - protein, 19 aa, Homo sapiens
ASTNGLINFIKQQREARVQ

SEQ ID NO: 4551 - protein, 19 aa, Homo sapiens
EDLERLLPHKVFEGNRPTN

SEQ ID NO: 4552 - protein, 19 aa, Homo sapiens
FEFWDWVGGRYSLWSAIGL

SEQ ID NO: 4553 - protein, 19 aa, Homo sapiens
NYTEGRAVLHVALRNRSNT

SEQ ID NO: 4554 - protein, 19 aa, Homo sapiens
SFCQRVRSGDWKGYTGKTI

SEQ ID NO: 4555 - protein, 21 aa, Homo sapiens
YLASASTMDHARHGFLPRRHR

SEQ ID NO: 4556 - protein, 5 aa, Homo sapiens
PAPKK

SEQ ID NO: 4557 - protein, 5 aa, Homo sapiens
PAPKK

SEQ ID NO: 4558 - protein, 7 aa, Homo sapiens
PAPKKGS

SEQ ID NO: 4559 - protein, 8 aa, Homo sapiens
PAPKKGSK

SEQ ID NO: 4560 - protein, 9 aa, Homo sapiens
PAPKKGSKK

SEQ ID NO: 4561 - protein, 5 aa, Homo sapiens
PEPAK

SEQ ID NO: 4562 - protein, 21 aa, Homo sapiens
PEPAKSAPAPKKGSKKAVTKA

SEQ ID NO: 4563 - protein, 21 aa, Homo sapiens
PEPAKSAPAPKKGSKKAVTKA

SEQ ID NO: 4564 - protein, 21 aa, Homo sapiens
PEPAKSAPAPKKGSKKAVTKA

SEQ ID NO: 4565 - protein, 9 aa, Mus musculus
KTEKDPESE

SEQ ID NO: 4566 - protein, 12 aa, Bos taurus
AAGAVMRGFVFT

SEQ ID NO: 4567 - protein, 13 aa, Homo sapiens
IPSTVKAGELEKI

SEQ ID NO: 4568 - protein, 12 aa, Homo sapiens
ISRCQVCMKKRH

SEQ ID NO: 4569 - protein, 5 aa, Homo sapiens
MKKRH

SEQ ID NO: 4570 - protein, 11 aa, Homo sapiens
SLNPERMFRKP

SEQ ID NO: 4571 - protein, 36 aa, Homo sapiens
SLNPERMFRKPIPSTVKAGELEKIISRCQVCMKKRH

SEQ ID NO: 4572 - protein, 15 aa, Homo sapiens
TAIPSCPEGTVPLYS

SEQ ID NO: 4573 - protein, 9 aa, Homo sapiens
ISLWKGFSF

SEQ ID NO: 4574 - protein, 15 aa, Homo sapiens
TDIPPCPHGWISLWK

SEQ ID NO: 4575 - protein, 20 aa, Bos taurus
CNFASRNDYSYWLSTPEPMP

SEQ ID NO: 4576 - protein, 9 aa, Homo sapiens
GSPATWTTR

SEQ ID NO: 4577 - protein, 239 aa, Homo sapiens
RGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 4578 - protein, 15 aa, Bos taurus
CFEGQEKAHNQDLGL

SEQ ID NO: 4579 - protein, 15 aa, Bos taurus
CHGRGTCNYYANAYS

SEQ ID NO: 4580 - protein, 19 aa, Bos taurus
CNYYSNSYSFWLASLDPKR

SEQ ID NO: 4581 - protein, 13 aa, Bos taurus
CPAGWISLWKGFS

SEQ ID NO: 4582 - protein, 23 aa, Bos taurus
CTIERSEMFKPTPSTLKAGELRT

SEQ ID NO: 4583 - protein, 14 aa, Bos taurus
CYYASRNDKSYWLS

SEQ ID NO: 4584 - protein, 18 aa, Bos taurus
DVCNFASRNDYSYWLSTP

SEQ ID NO: 4585 - protein, 6 aa, Bos taurus
GLGFYG

SEQ ID NO: 4586 - protein, 18 aa, Homo sapiens
KFDVPCGGRDCSGGCQCY

SEQ ID NO: 4587 - protein, 14 aa, Bos taurus
LEPYISRCTVCEGP

SEQ ID NO: 4588 - protein, 13 aa, Bos taurus
PYALGKEERDRYR

SEQ ID NO: 4589 - protein, 20 aa, Homo sapiens
AIAVHSQTTDIPPCPHGWIS

SEQ ID NO: 4590 - protein, 20 aa, Homo sapiens
ALASPGSCLEEFRASPFLEC

SEQ ID NO: 4591 - protein, 20 aa, Homo sapiens
ALMPMNMAPITGRALEPYIS

SEQ ID NO: 4592 - protein, 20 aa, Homo sapiens
EFRASPFLECHGRGTCNYYS

SEQ ID NO: 4593 - protein, 20 aa, Homo sapiens
FTTMPFLFCNVNDVCNFASR

SEQ ID NO: 4594 - protein, 20 aa, Homo sapiens
HGRGTCNYYSNSYSFWLASL

SEQ ID NO: 4595 - protein, 20 aa, Homo sapiens
IPPCPHGWISLWKGFSFIMF

SEQ ID NO: 4596 - protein, 20 aa, Homo sapiens
IPSCPEGTVPLYSGFSFLFV

SEQ ID NO: 4597 - protein, 14 aa, Homo sapiens
KIISRCQVCMKKRH

SEQ ID NO: 4598 - protein, 20 aa, Homo sapiens
LGTLGSCLQRFTTMPFLFCN

SEQ ID NO: 4599 - protein, 20 aa, Homo sapiens
LWKGFSFIMFTSAGSEGTGQ

SEQ ID NO: 4600 - protein, 20 aa, Homo sapiens
LYSGFSFLFVQGNQRAHGQD

SEQ ID NO: 4601 - protein, 20 aa, Homo sapiens
NDYSYWLSIPALMPMNMAPI

SEQ ID NO: 4602 - protein, 20 aa, Homo sapiens
NSYSFWLASLNPERMFRKPI

SEQ ID NO: 4603 - protein, 20 aa, Homo sapiens
PSTVKAGELEKIISRCQVCM

SEQ ID NO: 4604 - protein, 20 aa, Homo sapiens
RCTVCEGPAIAIAVHSQTTD

SEQ ID NO: 4605 - protein, 20 aa, Homo sapiens
SPATWTTRGFVFTRHSQTTA

SEQ ID NO: 4606 - protein, 20 aa, Homo sapiens
TGRALEPYISRCTVCEGPAI

SEQ ID NO: 4607 - protein, 20 aa, Homo sapiens
TSAGSEGTGQALASPGSCLE

SEQ ID NO: 4608 - protein, 21 aa, Homo sapiens
VFTRHSQTTAIPSCPEGTVPL

SEQ ID NO: 4609 - protein, 21 aa, Homo sapiens
VNDVCNFASRNDYSYWLSTPA

SEQ ID NO: 4610 - protein, 44 aa, Homo sapiens
PGLKGKRGDSGSPATWTTRGFVFTRHSQTTAIPSCPEGTVPLYS

SEQ ID NO: 4611 - protein, 1670 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTPGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEYGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGRPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 4612 - protein, 20 aa, Mus musculus
CPQDWVSLWKGFSFIMFTSA

SEQ ID NO: 4613 - protein, 11 aa, Mus musculus
DWVSLWKGFSF

SEQ ID NO: 4614 - protein, 16 aa, Mycobacterium tuberculosis
DLSLLGKARKVVVTKD

SEQ ID NO: 4615 - protein, 15 aa, Mycobacterium bovis
NPLGLKRGIEKAVEK

SEQ ID NO: 4616 - protein, 16 aa, Homo sapiens
QPHDLGKVGEVIVTKD

SEQ ID NO: 4617 - protein, 13 aa, Human herpesvirus
SYLKDSDFLDAAL

SEQ ID NO: 4618 - protein, 13 aa, Homo sapiens
SYLQDSDPDSFQD

SEQ ID NO: 4619 - protein, 14 aa, Homo sapiens
ALNEDLRSWTAADT

SEQ ID NO: 4620 - protein, 14 aa, Homo sapiens
ALNEDLSSWTAADT

SEQ ID NO: 4621 - protein, 15 aa, Homo sapiens
NPVEIRRGVMLAVDA

SEQ ID NO: 4622 - protein, 25 aa, Homo sapiens
QVSGPERTIPITREEKPAVTAAPKK

SEQ ID NO: 4623 - protein, 14 aa, Homo sapiens
DLYILMSHTSGSAA

SEQ ID NO: 4624 - protein, 14 aa, Homo sapiens
FLGELTSSEVATEV

SEQ ID NO: 4625 - protein, 14 aa, Homo sapiens
GVYLLTSHRTATAA

SEQ ID NO: 4626 - protein, 16 aa, Homo sapiens
KSMVILTSTVTAGTAE

SEQ ID NO: 4627 - protein, 12 aa, Bos taurus
NNRERRGIALDG

SEQ ID NO: 4628 - protein, 15 aa, Bos taurus
ADGSSWEGVGVVPDV

SEQ ID NO: 4629 - protein, 20 aa, Homo sapiens
GPTHLFQPSLVLDMAKVLLD

SEQ ID NO: 4630 - protein, 20 aa, Homo sapiens
SGIPYIISYLHPGNTILHVD

SEQ ID NO: 4631 - protein, 20 aa, Homo sapiens
ASSTIIKEGIDRTVLGILVS

SEQ ID NO: 4632 - protein, 13 aa, Homo sapiens
DTNLASSTIIKEG

SEQ ID NO: 4633 - protein, 20 aa, Homo sapiens
GFLGELTSSEVATEVPFRLM

SEQ ID NO: 4634 - protein, 16 aa, Bos taurus
LPLLANNRERRGIALD

SEQ ID NO: 4635 - protein, 14 aa, Bos taurus
NLYLTIPTARSVGA

SEQ ID NO: 4636 - protein, 20 aa, Homo sapiens
NRERRGIALDGKIKHEDTNL

SEQ ID NO: 4637 - protein, 12 aa, Homo sapiens
PTARSVGAADGS

SEQ ID NO: 4638 - protein, 23 aa, Bos taurus
PTARSVGAADGSSWEGVGVVPDV

SEQ ID NO: 4639 - protein, 14 aa, Bos taurus
VGAADGSSWEGVGV

SEQ ID NO: 4640 - protein, 20 aa, Homo sapiens
YQIKVKLTVSGFLGELTSSE

SEQ ID NO: 4641 - protein, 20 aa, Homo sapiens
LLANNRERRGIALDGKIKHE

SEQ ID NO: 4642 - protein, 16 aa, Homo sapiens
NRERRGIALDGKIKHE

SEQ ID NO: 4643 - protein, 25 aa, Homo sapiens
DKFVIFLDVKHFSPEDLTVKVQDDF

SEQ ID NO: 4644 - protein, 25 aa, Homo sapiens
GLDATHAERAIPVSREEKPTSAPSS

SEQ ID NO: 4645 - protein, 25 aa, Homo sapiens
GMLTFCGPKIQTGLDATHAERAIPV

SEQ ID NO: 4646 - protein, 25 aa, Homo sapiens
LSSDGVLTVNGPRKQVSGPERTIPI

SEQ ID NO: 4647 - protein, 25 aa, Homo sapiens
PEELKVKVLGDVIEVHGKHEERQDE

SEQ ID NO: 4648 - protein, 25 aa, Homo sapiens
RLEKDRFSVNLDVKHFSPEELKVKV

SEQ ID NO: 4649 - protein, 25 aa, Homo sapiens
TVKVQDDFVEIHGKHNERQDDHGYI

SEQ ID NO: 4650 - protein, 14 aa, Mus musculus
QTWEGSGVLPCVGT

SEQ ID NO: 4651 - protein, 20 aa, Mus musculus
SYSSAVPLLCSYFFEAEPRQ

SEQ ID NO: 4652 - protein, 20 aa, unidentified
  REGION 1..20: note = epitope involved in autoimmune uvetisis
ENSDSDYDREALQERLAKLA

SEQ ID NO: 4653 - protein, 20 aa, Mycobacterium leprae
ENSDSDYDREKLQERLAKLA

SEQ ID NO: 4654 - protein, 15 aa, Homo sapiens
LSSVVVDPSIRHFDV

SEQ ID NO: 4655 - protein, 15 aa, Homo sapiens
DVGEYRAVTELGRPD

SEQ ID NO: 4656 - protein, 15 aa, Homo sapiens
DVGVYRAVTPQGRPD

SEQ ID NO: 4657 - protein, 14 aa, Homo sapiens
GNRIAQWQSFQLEG

SEQ ID NO: 4658 - protein, 15 aa, Homo sapiens
KVKKIYLDEKRLLAG

SEQ ID NO: 4659 - protein, 31 aa, Homo sapiens; identical to SEQ ID NO: 923

SEQ ID NO: 4660 - protein, 11 aa, Homo sapiens
VLSPADKTNVK

SEQ ID NO: 4661 - protein, 31 aa, Homo sapiens; identical to SEQ ID NO: 928

SEQ ID NO: 4662 - protein, 14 aa, Homo sapiens
VVAGVANALAHKYH

SEQ ID NO: 4663 - protein, 19 aa, Homo sapiens
GLPRLETPADLSTAIASRS

SEQ ID NO: 4664 - protein, 11 aa, Homo sapiens
HARLRDSGRAY

SEQ ID NO: 4665 - protein, 20 aa, Homo sapiens
CNESSMQSLRQRKSVNALNS

SEQ ID NO: 4666 - protein, 20 aa, Homo sapiens
FQDTHNNAHYYVFFEEQEDE

SEQ ID NO: 4667 - protein, 19 aa, Homo sapiens
GIFNTGLKMFPDLTKVYST

SEQ ID NO: 4668 - protein, 16 aa, Homo sapiens
GPSLLDVSQTSVTALP

SEQ ID NO: 4669 - protein, 19 aa, Homo sapiens
IQRIPSLPPSTQTLKLIET

SEQ ID NO: 4670 - protein, 19 aa, Homo sapiens
ITDNPYMTSIPVNAFQGLC

SEQ ID NO: 4671 - protein, 20 aa, Homo sapiens
KNPQEETLQAFDSHYDYTIC

SEQ ID NO: 4672 - protein, 20 aa, Homo sapiens
LTRADLSYPSHCCAFKNQKK

SEQ ID NO: 4673 - protein, 19 aa, Homo sapiens
PDALKELPLLKFLGIFNTG

SEQ ID NO: 4674 - protein, 20 aa, Homo sapiens
PPARALKRSLWVEVDLLIGS

SEQ ID NO: 4675 - protein, 20 aa, Homo sapiens
PYEFSRKVPTFATPWPDFVP

SEQ ID NO: 4676 - protein, 19 aa, Homo sapiens
TKVYSTDIFFILEITDNPY

SEQ ID NO: 4677 - protein, 20 aa, Homo sapiens
VNALNSPLHQEYEENLGDSI

SEQ ID NO: 4678 - protein, 20 aa, Homo sapiens
ASRSVADKILDLYKHPDNID

SEQ ID NO: 4679 - protein, 12 aa, Homo sapiens
DPLIRGLLARPA

SEQ ID NO: 4680 - protein, 18 aa, Homo sapiens
EPTSGVIARAAEIMETSI

SEQ ID NO: 4681 - protein, 19 aa, Homo sapiens
FQQYVGPYEGYDSTANPTV

SEQ ID NO: 4682 - protein, 20 aa, Homo sapiens
HGLPGYNEWREFCGLPRLET

SEQ ID NO: 4683 - protein, 20 aa, Homo sapiens
HPDNIDVWLGGLAENFLPRA

SEQ ID NO: 4684 - protein, 18 aa, Homo sapiens
HWSADAVYQEARKVVGAL

SEQ ID NO: 4685 - protein, 20 aa, Homo sapiens
IPGMMLEAWRETFPQDDKCG

SEQ ID NO: 4686 - protein, 20 aa, Homo sapiens
KFPEDFESCDSIPGMMLEAW

SEQ ID NO: 4687 - protein, 19 aa, Homo sapiens
KVVGALHQIITLRDYIPRI

SEQ ID NO: 4688 - protein, 20 aa, Homo sapiens
LIGKQMKALRDGDWFWWENS

SEQ ID NO: 4689 - protein, 20 aa, Homo sapiens
LPRLETPADLSTAIASRSVA

SEQ ID NO: 4690 - protein, 20 aa, Homo sapiens
NFLPRARTGPLFACLIGKQM

SEQ ID NO: 4691 - protein, 18 aa, Homo sapiens
NRLAAALKALNAHWSADA

SEQ ID NO: 4692 - protein, 18 aa, Homo sapiens
RDYIPRILGPEAFQQYVG

SEQ ID NO: 4693 - protein, 13 aa, Homo sapiens
RGLLARPAKLQVQ

SEQ ID NO: 4694 - protein, 18 aa, Homo sapiens
TAAFRFGHATIHPLVRRL

SEQ ID NO: 4695 - protein, 933 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 4696 - protein, 26 aa, Homo sapiens
DNTGLTRVPMDAFQVGKFPEDFESCD

SEQ ID NO: 4697 - protein, 20 aa, Homo sapiens
DSHYDYTICGDSEDMVCTPK

SEQ ID NO: 4698 - protein, 20 aa, Homo sapiens
FQGLCNETLTLKLYNNGFTS

SEQ ID NO: 4699 - protein, 33 aa, Homo sapiens
GYNEWREFCGLPRLETPADLSTAIASRSVADKI

SEQ ID NO: 4700 - protein, 45 aa, Homo sapiens
INLQRGRDHGLPGYNEWREFCGLPRLETPADLSTAIASRSVADKI

SEQ ID NO: 4701 - protein, 20 aa, Homo sapiens
IRGILESLMCNESSMQSLRQ

SEQ ID NO: 4702 - protein, 20 aa, Homo sapiens
KLPLSLSFLHLTRADLSYPS

SEQ ID NO: 4703 - protein, 20 aa, Homo sapiens
LDAVYLNKNKYLTVIDKDAF

SEQ ID NO: 4704 - protein, 20 aa, Homo sapiens
LHQEYEENLGDSIVGYKEKS

SEQ ID NO: 4705 - protein, 20 aa, Homo sapiens
NGFTSVQGYAFNGTKLDAVY

SEQ ID NO: 4706 - protein, 13 aa, Homo sapiens
QVGKFPEDFESCD

SEQ ID NO: 4707 - protein, 12 aa, Homo sapiens
STDDYASFSRAL

SEQ ID NO: 4708 - protein, 20 aa, Homo sapiens
YVSIDVTLQQLESHSFYNLS

SEQ ID NO: 4709 - protein, 20 aa, Homo sapiens
YYVFFEEQEDEIIGFGQELK

SEQ ID NO: 4710 - protein, 21 aa, Homo sapiens
DLYTHSEYYNHAIDWQTGPGC

SEQ ID NO: 4711 - protein, 19 aa, Mus musculus
NTTDMMIFDLIHNYNRFPD

SEQ ID NO: 4712 - protein, 16 aa, Homo sapiens
YAFNGTKLDAVYLNKN

SEQ ID NO: 4713 - protein, 11 aa, Homo sapiens
NKPLITVTNSK

SEQ ID NO: 4714 - protein, 9 aa, Rattus norvegicus
PPGEQTMGV

SEQ ID NO: 4715 - protein, 20 aa, Homo sapiens
VCTPKSDEFNPCEDIMGYKF

SEQ ID NO: 4716 - protein, 50 aa, Homo sapiens
ATKKEEEKKGGDRNTGLSRDKDKKREEMKEVAKKEDDEKVKGERRNTDTR

SEQ ID NO: 4717 - protein, 39 aa, Homo sapiens
LLKENTSLLKLGYHFELAGPRMTVTNLLSRNMDKQRQKR

SEQ ID NO: 4718 - protein, 37 aa, Homo sapiens
RGRDASKKALGPRRNSDLGKEPKRGGLKKSFSRDRDE

SEQ ID NO: 4719 - protein, 27 aa, Homo sapiens
ADLSTAIASRSVADKILDLYKHPDNID

SEQ ID NO: 4720 - protein, 20 aa, Homo sapiens
AFQVGKFPEDFESCDSIPGM

SEQ ID NO: 4721 - protein, 20 aa, Homo sapiens
AHPPCHASARCRNTKGGFQC

SEQ ID NO: 4722 - protein, 20 aa, Homo sapiens
ALKALNAHWSADAVYQEARK

SEQ ID NO: 4723 - protein, 20 aa, Homo sapiens
APEPGIPGETRGPCFLAGDG

SEQ ID NO: 4724 - protein, 20 aa, Homo sapiens
DPLIRGLLARPAKLQVQDQL

SEQ ID NO: 4725 - protein, 20 aa, Homo sapiens
EESGRRVLVYSCRHGYELQG

SEQ ID NO: 4726 - protein, 20 aa, Homo sapiens
EGWDFQPPLCKDVNECADGA

SEQ ID NO: 4727 - protein, 20 aa, Homo sapiens
ESRVSSVLEESKRLVDTAMY

SEQ ID NO: 4728 - protein, 20 aa, Homo sapiens
FSKLPEPTSGVIARAAEIME

SEQ ID NO: 4729 - protein, 21 aa, Homo sapiens
GGADCQMTCENQNPCFPIQLP

SEQ ID NO: 4730 - protein, 20 aa, Homo sapiens
GLWLHQAFFSPWTLLRGGGL

SEQ ID NO: 4731 - protein, 21 aa, Homo sapiens
GMNLEAWRETFPDQDDKCGFP

SEQ ID NO: 4732 - protein, 20 aa, Homo sapiens
GRLPRATWISMSLAALLIGG

SEQ ID NO: 4733 - protein, 20 aa, Homo sapiens
HSLSRVICDNTGLTRVPMDA

SEQ ID NO: 4734 - protein, 20 aa, Homo sapiens
HVIQVSNEVVTDDDRYSDLL

SEQ ID NO: 4735 - protein, 20 aa, Homo sapiens
KCPNTCLANKYRPITGACNN

SEQ ID NO: 4736 - protein, 20 aa, Homo sapiens
LPISETGGGTPELRCGKHQA

SEQ ID NO: 4737 - protein, 20 aa, Homo sapiens
METSIQAMKRKVNLKTQQSQ

SEQ ID NO: 4738 - protein, 20 aa, Homo sapiens
NEWREFCGLPRLETPADLST

SEQ ID NO: 4739 - protein, 22 aa, Homo sapiens
NEWREFCGLPRLETPADLSTAI

SEQ ID NO: 4740 - protein, 12 aa, Homo sapiens
NIFEYQVDAQPL

SEQ ID NO: 4741 - protein, 20 aa, Homo sapiens
PCFLAGDGRASEVPSLTALH

SEQ ID NO: 4742 - protein, 25 aa, Homo sapiens
PGYNEWREFCGLPRLETPADLSTAI

SEQ ID NO: 4743 - protein, 45 aa, Homo sapiens
PGYNEWREFCGLPRLETPADLSTAIASRSVADKILDLYKHPDNID

SEQ ID NO: 4744 - protein, 18 aa, Homo sapiens
QESAGMEGRDTHRLPRAL

SEQ ID NO: 4745 - protein, 20 aa, Homo sapiens
QQSQHPTDALSEDLLSIIAN

SEQ ID NO: 4746 - protein, 20 aa, Homo sapiens
QRNLKKRGILSPAQLLSFSK

SEQ ID NO: 4747 - protein, 20 aa, Homo sapiens
RPITGACNNRDHPRWGASNT

SEQ ID NO: 4748 - protein, 20 aa, Homo sapiens
TEAFFPFISRGKELLWGKPE

SEQ ID NO: 4749 - protein, 20 aa, Homo sapiens
VGPYEGYDSTANPTVSNVFS

SEQ ID NO: 4750 - protein, 20 aa, Homo sapiens
YEDGFSQPRGWNPGFLYNGF

SEQ ID NO: 4751 - protein, 20 aa, Homo sapiens
YELQGREQLTCTQEGWDFQP

SEQ ID NO: 4752 - protein, 15 aa, Homo sapiens
ALKALNAHWSADAVY

SEQ ID NO: 4753 - protein, 20 aa, Homo sapiens
AMKRKVNLKTQQSQHPTDAL

SEQ ID NO: 4754 - protein, 18 aa, Homo sapiens
GLPRLETPADLSTAIASR

SEQ ID NO: 4755 - protein, 13 aa, Homo sapiens
HPTDALSEDLLSI

SEQ ID NO: 4756 - protein, 13 aa, Homo sapiens
HVIQVSNEVVTDD

SEQ ID NO: 4757 - protein, 15 aa, Homo sapiens
IASRSVADKILDLYK

SEQ ID NO: 4758 - protein, 20 aa, Homo sapiens
LYKHPDNIDVWLGGLAENFL

SEQ ID NO: 4759 - protein, 15 aa, Homo sapiens
MTCENQNPCFPIQLP

SEQ ID NO: 4760 - protein, 18 aa, Homo sapiens
VGALHQIITLRDYIPRIL

SEQ ID NO: 4761 - protein, 10 aa, Homo sapiens
LVVYPWTQRF

SEQ ID NO: 4762 - protein, 15 aa, Homo sapiens
AAGLLSTYRAFLSSH

SEQ ID NO: 4763 - protein, 27 aa, Homo sapiens
AAHLPAEFTPAVHASLDKFLASVSTVL

SEQ ID NO: 4764 - protein, 32 aa, Homo sapiens
AAHLPAEFTPAVHASLDKFLASVSTVLTSKYR

SEQ ID NO: 4765 - protein, 21 aa, Homo sapiens
AAWGKVGAHAGEYGAEALERM

SEQ ID NO: 4766 - protein, 29 aa, Homo sapiens
AAWGKVGAHAGEYGAEALERMFLSFPTTK

SEQ ID NO: 4767 - protein, 19 aa, Homo sapiens
AFTPEGERLIGDAAKNQLT

SEQ ID NO: 4768 - protein, 14 aa, Homo sapiens
AGLLSTYRAFLSSH

SEQ ID NO: 4769 - protein, 15 aa, Homo sapiens
AGNLGGGVVTIERSK

SEQ ID NO: 4770 - protein, 15 aa, Homo sapiens
AHLLILRDTKTYMLA

SEQ ID NO: 4771 - protein, 16 aa, Homo sapiens
AHLLILRDTKTYMLAF

SEQ ID NO: 4772 - protein, 13 aa, Homo sapiens
AKAVKQFEESQGR

SEQ ID NO: 4773 - protein, 17 aa, Homo sapiens
AKAVKQFEESQGRTSSK

SEQ ID NO: 4774 - protein, 12 aa, Homo sapiens
AKFEELNMDLFR

SEQ ID NO: 4775 - protein, 18 aa, Homo sapiens
AKVAVLGASGGIGQPLSL

SEQ ID NO: 4776 - protein, 16 aa, Homo sapiens
ASGNYATVISHNPETK

SEQ ID NO: 4777 - protein, 12 aa, Homo sapiens
ASVSTVLTSKYR

SEQ ID NO: 4778 - protein, 16 aa, Homo sapiens
AVPSPPPASPRSQYNF

SEQ ID NO: 4779 - protein, 19 aa, Homo sapiens
AVPSPPPASPRSQYNFIAD

SEQ ID NO: 4780 - protein, 24 aa, Homo sapiens
AVTELGRPDAEYWNSQKDLLEQKR

SEQ ID NO: 4781 - protein, 17 aa, Homo sapiens
AYVRLAPDYDALDVANK

SEQ ID NO: 4782 - protein, 18 aa, Homo sapiens
DGRGALQNIIPASTGAAK

SEQ ID NO: 4783 - protein, 13 aa, Homo sapiens
DGVIKVFNDMKVR

SEQ ID NO: 4784 - protein, 15 aa, Homo sapiens
DIPELVNMGQWKIRA

SEQ ID NO: 4785 - protein, 16 aa, Homo sapiens
DKFLASVSTVLTSKYR

SEQ ID NO: 4786 - protein, 18 aa, Homo sapiens
DPSPSPVLGYKIVYKPVG

SEQ ID NO: 4787 - protein, 10 aa, Homo sapiens
DRVYIHPFHL

SEQ ID NO: 4788 - protein, 13 aa, Homo sapiens
DTNADKQLSFEEF

SEQ ID NO: 4789 - protein, 16 aa, Homo sapiens
DVPKWISIMTERSVPH

SEQ ID NO: 4790 - protein, 12 aa, Homo sapiens
EDFRDGLKLMLL

SEQ ID NO: 4791 - protein, 14 aa, Homo sapiens
EDIVADHVASYGVN

SEQ ID NO: 4792 - protein, 15 aa, Homo sapiens
EGLTFQMKKNAEELK

SEQ ID NO: 4793 - protein, 11 aa, Homo sapiens
EITALAPSTMK

SEQ ID NO: 4794 - protein, 15 aa, Homo sapiens
EQFYVDLDKKETVWH

SEQ ID NO: 4795 - protein, 14 aa, Homo sapiens
FDPIIEDRHGGYKP

SEQ ID NO: 4796 - protein, 15 aa, Homo sapiens
FDPIIEDRHGGYKPS

SEQ ID NO: 4797 - protein, 11 aa, Homo sapiens
FDSDVGEYRAV

SEQ ID NO: 4798 - protein, 18 aa, Homo sapiens
FESFGDLSTPDAVMGNPK

SEQ ID NO: 4799 - protein, 20 aa, Homo sapiens
FESFGDLSTPDAVMGNPKVK

SEQ ID NO: 4800 - protein, 14 aa, Homo sapiens
FLASVSTVLTSKYR

SEQ ID NO: 4801 - protein, 10 aa, Homo sapiens
FLENVIRDAV

SEQ ID NO: 4802 - protein, 24 aa, Homo sapiens
FLSFPTTKTYFPHFDLSHGSAQVK

SEQ ID NO: 4803 - protein, 28 aa, Homo sapiens
FLSFPTTKTYFPHFDLSHGSAQVKGHGK

SEQ ID NO: 4804 - protein, 29 aa, Homo sapiens
FLSFPTTKTYFPHFDLSHGSAQVKGHGKK

SEQ ID NO: 4805 - protein, 15 aa, Homo sapiens
GAPAAATAPAPTAHK

SEQ ID NO: 4806 - protein, 15 aa, Homo sapiens
GELEKEEAQPIVTKY

SEQ ID NO: 4807 - protein, 15 aa, Homo sapiens
GGELRFTVTQRSQPG

SEQ ID NO: 4808 - protein, 15 aa, Homo sapiens
GKEYFAIDNSGRIIT

SEQ ID NO: 4809 - protein, 12 aa, Homo sapiens
GLTFQMKKNAEE

SEQ ID NO: 4810 - protein, 14 aa, Homo sapiens
GLTFQMKKNAEELK

SEQ ID NO: 4811 - protein, 15 aa, Homo sapiens
GNRIAQWQSFQLEGG

SEQ ID NO: 4812 - protein, 18 aa, Homo sapiens
GRMHAPGKGLSQSALPYR

SEQ ID NO: 4813 - protein, 14 aa, Homo sapiens
GTLIIRDVKESDQG

SEQ ID NO: 4814 - protein, 17 aa, Homo sapiens
GTQGKIVDLVKELDRDT

SEQ ID NO: 4815 - protein, 12 aa, Homo sapiens
IGSSQDDGLINR

SEQ ID NO: 4816 - protein, 16 aa, Homo sapiens
IGSSYFPEHGYFRAPE

SEQ ID NO: 4817 - protein, 9 aa, Homo sapiens
IKEESKTAV

SEQ ID NO: 4818 - protein, 8 aa, Homo sapiens
IPDWFLNR

SEQ ID NO: 4819 - protein, 16 aa, Homo sapiens
IRASYAQQPAESRVSG

SEQ ID NO: 4820 - protein, 13 aa, Homo sapiens
ISWYDNEFGYSNR

SEQ ID NO: 4821 - protein, 18 aa, Homo sapiens
IVNTNVPRASVPDGFLSE

SEQ ID NO: 4822 - protein, 22 aa, Homo sapiens
IVNTNVPRASVPDGFLSELTQQ

SEQ ID NO: 4823 - protein, 18 aa, Homo sapiens
IYTRNTKGGDAPAAGEDA

SEQ ID NO: 4824 - protein, 13 aa, Homo sapiens
KAVLTIDEKGTEA

SEQ ID NO: 4825 - protein, 15 aa, Homo sapiens
KAVLTIDEKGTEAAG

SEQ ID NO: 4826 - protein, 14 aa, Homo sapiens
KEYFAIDNSGRIIT

SEQ ID NO: 4827 - protein, 15 aa, Homo sapiens
KFLASVSTVLTSKYR

SEQ ID NO: 4828 - protein, 15 aa, Homo sapiens
KPGQFIRSVDPDSPA

SEQ ID NO: 4829 - protein, 26 aa, Homo sapiens
KTNVKAAWGKVGAHAGEYGAEALERM

SEQ ID NO: 4830 - protein, 21 aa, Homo sapiens
LAQATGKPPQYIAVHVVPDQL

SEQ ID NO: 4831 - protein, 14 aa, Homo sapiens
LISWYDNEFGYSNR

SEQ ID NO: 4832 - protein, 12 aa, Homo sapiens
LITPAVVSERLK

SEQ ID NO: 4833 - protein, 13 aa, Homo sapiens
LKKYLYEIARRHP

SEQ ID NO: 4834 - protein, 19 aa, Homo sapiens
LLTEAPLNPKANREKMTQI

SEQ ID NO: 4835 - protein, 10 aa, Homo sapiens
LLVVYPWTQR

SEQ ID NO: 4836 - protein, 11 aa, Homo sapiens
LLVVYPWTQRF

SEQ ID NO: 4837 - protein, 9 aa, Homo sapiens
LRVDPVNFK

SEQ ID NO: 4838 - protein, 10 aa, Homo sapiens
LSLQEPGSKT

SEQ ID NO: 4839 - protein, 22 aa, Homo sapiens
LVTLAAHLPAEFTPAVHASLDK

SEQ ID NO: 4840 - protein, 16 aa, Homo sapiens
NIFSFYLSRDPDAQPG

SEQ ID NO: 4841 - protein, 21 aa, Homo sapiens
PMFIVNTNVPRASVPDGFLSE

SEQ ID NO: 4842 - protein, 15 aa, Homo sapiens
QLQPDNSTLTWVKPT

SEQ ID NO: 4843 - protein, 18 aa, Homo sapiens
QVDQFLGVPYAAPPLAER

SEQ ID NO: 4844 - protein, 18 aa, Homo sapiens
QVTQPTVGMNFKTPRGPV

SEQ ID NO: 4845 - protein, 13 aa, Homo sapiens
REIFNMARDQRSR

SEQ ID NO: 4846 - protein, 12 aa, Homo sapiens
RFDSDVGEFRAV

SEQ ID NO: 4847 - protein, 14 aa, Homo sapiens
RGNSIIMLEALERV

SEQ ID NO: 4848 - protein, 13 aa, Homo sapiens
RLLLPGELAKHAV

SEQ ID NO: 4849 - protein, 18 aa, Homo sapiens
RLLLPGELAKHAVSEGTK

SEQ ID NO: 4850 - protein, 16 aa, Homo sapiens
RLPIIDVAPLDVGAPD

SEQ ID NO: 4851 - protein, 16 aa, Homo sapiens
RPKDYEVDATLKSLNN

SEQ ID NO: 4852 - protein, 16 aa, Homo sapiens
RVMTIAPGLFGTPLLT

SEQ ID NO: 4853 - protein, 13 aa, Homo sapiens
RYSVDIPLDKTVV

SEQ ID NO: 4854 - protein, 21 aa, Homo sapiens
SETAPAAPAAAPPAEKAPVKK

SEQ ID NO: 4855 - protein, 22 aa, Homo sapiens
SETAPAAPAAAPPAEKAPVKKK

SEQ ID NO: 4856 - protein, 33 aa, Homo sapiens
SGNFGGSRNMGGPYGGGNYGPGGSGGSGGYGGR

SEQ ID NO: 4857 - protein, 14 aa, Homo sapiens
SRAGLELGAEPETI

SEQ ID NO: 4858 - protein, 11 aa, Homo sapiens
SRTSGLLSSWK

SEQ ID NO: 4859 - protein, 14 aa, Homo sapiens
SVPRYLPRPANPDE

SEQ ID NO: 4860 - protein, 16 aa, Homo sapiens
SWNSGALTSGVHTFPA

SEQ ID NO: 4861 - protein, 14 aa, Homo sapiens
SWYDNEFGYSNRVV

SEQ ID NO: 4862 - protein, 18 aa, Homo sapiens
SYELPDGQVITIGNERFR

SEQ ID NO: 4863 - protein, 16 aa, Homo sapiens
TGAAPIIDVVRSGYYK

SEQ ID NO: 4864 - protein, 23 aa, Homo sapiens
TGGASGLGLATAERLVGQGASAV

SEQ ID NO: 4865 - protein, 13 aa, Homo sapiens
TGKNKWFFQKLRF

SEQ ID NO: 4866 - protein, 15 aa, Homo sapiens
TNVPPEVTVLTNSPV

SEQ ID NO: 4867 - protein, 14 aa, Homo sapiens
TQGKIVDLVKELDR

SEQ ID NO: 4868 - protein, 16 aa, Homo sapiens
TQGKIVDLVKELDRDT

SEQ ID NO: 4869 - protein, 11 aa, Homo sapiens
TVDGPSGKLWR

SEQ ID NO: 4870 - protein, 17 aa, Homo sapiens
TWLRNGKPVTTGVSETV

SEQ ID NO: 4871 - protein, 16 aa, Homo sapiens
TYFPHFDLSHGSAQVK

SEQ ID NO: 4872 - protein, 21 aa, Homo sapiens
TYFPHFDLSHGSAQVKGHGKK

SEQ ID NO: 4873 - protein, 29 aa, Homo sapiens
VADALTNAVAHVDDMPNALSALSDLHAHK

SEQ ID NO: 4874 - protein, 15 aa, Homo sapiens
VGAHAGEYGAEALER

SEQ ID NO: 4875 - protein, 24 aa, Homo sapiens
VGAHAGEYGAEALERMFLSFPTTK

SEQ ID NO: 4876 - protein, 17 aa, Homo sapiens
VHKAVLTIDEKGTEAAG

SEQ ID NO: 4877 - protein, 8 aa, Homo sapiens
VHLTPEEK

SEQ ID NO: 4878 - protein, 32 aa, Homo sapiens
VHLTPEEKSAVTALWGKVNVDEVGGEALGRLL

SEQ ID NO: 4879 - protein, 16 aa, Homo sapiens
VLSPADKTNVKAAWGK

SEQ ID NO: 4880 - protein, 32 aa, Homo sapiens
VLSPADKTNVKAAWGKVGAHAGEYGAEALERM

SEQ ID NO: 4881 - protein, 33 aa, Homo sapiens
VLSPADKTNVKAAWGKVGAHAGEYGAEALERMF

SEQ ID NO: 4882 - protein, 12 aa, Homo sapiens
VVDLMAHMASKE

SEQ ID NO: 4883 - protein, 11 aa, Homo sapiens
VWRLEEFGRFA

SEQ ID NO: 4884 - protein, 16 aa, Homo sapiens
WLRNGKPVTTGVSETV

SEQ ID NO: 4885 - protein, 10 aa, Homo sapiens
WRLEEFGRFA

SEQ ID NO: 4886 - protein, 14 aa, Homo sapiens
YDHNFVKAINAIQK

SEQ ID NO: 4887 - protein, 16 aa, Homo sapiens
YGGELRFTVTQRSQPG

SEQ ID NO: 4888 - protein, 16 aa, Homo sapiens
YPKSLHMYANRLLDHR

SEQ ID NO: 4889 - protein, 12 aa, Homo sapiens
YYKVDENGKISR

SEQ ID NO: 4890 - protein, 23 aa, Homo sapiens
AVTELGRPDAEYWNSQKDILEQK

SEQ ID NO: 4891 - protein, 18 aa, Homo sapiens
CPTPCQLQAEQAFLRTVQ

SEQ ID NO: 4892 - protein, 17 aa, Homo sapiens
FIVNTNVPRASVPDGFL

SEQ ID NO: 4893 - protein, 11 aa, Homo sapiens
LLIPTSFSPLK

SEQ ID NO: 4894 - protein, 20 aa, Homo sapiens
PAAPAAPAPAEKTPVKKKAR

SEQ ID NO: 4895 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHDMRQGLHNMEDVYELIENSHLTPKKQGQISEEYMQTVL

SEQ ID NO: 4896 - protein, 9 aa, Homo sapiens
ALAVLSVTL

SEQ ID NO: 4897 - protein, 9 aa, Homo sapiens
ALSEDLLSI

SEQ ID NO: 4898 - protein, 9 aa, Homo sapiens
GLLDQVAAL

SEQ ID NO: 4899 - protein, 9 aa, Homo sapiens
GLREDLLSL

SEQ ID NO: 4900 - protein, 9 aa, Homo sapiens
LLIGGFAGL

SEQ ID NO: 4901 - protein, 10 aa, Homo sapiens
SLQDVPLAAL

SEQ ID NO: 4902 - protein, 9 aa, Streptococcus pyogenes
ALEKLNKEL

SEQ ID NO: 4903 - protein, 9 aa, Homo sapiens
EFQKMRRDL

SEQ ID NO: 4904 - protein, 9 aa, Streptococcus pyogenes
KLNKELEES

SEQ ID NO: 4905 - protein, 9 aa, Homo sapiens
KMRRDLEEA

SEQ ID NO: 4906 - protein, 43 aa, Homo sapiens
AERAALEELVKLQGERVRGLKQQKASAELIEEEVAKLLKLKAQ

SEQ ID NO: 4907 - protein, 25 aa, Homo sapiens
VAGRGRGRGRGRGRGRGRGRGGPRR

SEQ ID NO: 4908 - protein, 10 aa, Homo sapiens
GSASPMELLS

SEQ ID NO: 4909 - protein, 10 aa, Homo sapiens
IFMSNSYPRD

SEQ ID NO: 4910 - protein, 12 aa, Homo sapiens
RLDNRYQPMEPN

SEQ ID NO: 4911 - protein, 10 aa, Homo sapiens
SARIPCFLAG

SEQ ID NO: 4912 - protein, 10 aa, Homo sapiens
WDGERLYQEA

SEQ ID NO: 4913 - protein, 10 aa, Homo sapiens
WTPGVKRNGF

SEQ ID NO: 4914 - protein, 10 aa, Homo sapiens
YRSYNDSVDP

SEQ ID NO: 4915 - protein, 7 aa, Helicobacter pylori
AKEERRY

SEQ ID NO: 4916 - protein, 7 aa, unidentified
  REGION 1..7: note = epitope involved in autoimmune pancreatitis
RFEQPRV

SEQ ID NO: 4917 - protein, 7 aa, unidentified
  REGION 1..7: note = epitope involved in autoimmune pancreatitis
SKDERRF

SEQ ID NO: 4918 - protein, 15 aa, Mycobacterium avium
TCRRMLAFLKDKENR

SEQ ID NO: 4919 - protein, 15 aa, Homo sapiens
GEALSTLVLNRLKVG

SEQ ID NO: 4920 - protein, 15 aa, Mycobacterium sp.
GEALSTLVVNKIRGT

SEQ ID NO: 4921 - protein, 15 aa, Mycobacterium sp.
IAGLFLTTEAVVADK

SEQ ID NO: 4922 - protein, 15 aa, Homo sapiens
VASLLTTAEVVVTEI

SEQ ID NO: 4923 - protein, 9 aa, unidentified
  REGION 1..9: note = epitope involved in Crohn's disease
GGIYQDLVS

SEQ ID NO: 4924 - protein, 9 aa, unidentified
  REGION 1..9: note = epitope involved in Crohn's disease
GLLAQQMDY

SEQ ID NO: 4925 - protein, 9 aa, unidentified
  REGION 1..9: note = epitope involved in Crohn's disease
RLVGQQVMQ

SEQ ID NO: 4926 - protein, 9 aa, unidentified
  REGION 1..9: note = epitope involved in Crohn's disease
RQSDGQYQM

SEQ ID NO: 4927 - protein, 9 aa, unidentified
  REGION 1..9: note = epitope involved in Crohn's disease
YRWLPPSSA

SEQ ID NO: 4928 - protein, 15 aa, Mycobacterium avium
AGDLSKVDAKQPGDY

SEQ ID NO: 4929 - protein, 15 aa, Homo sapiens
CQALVRMLAKKPGWK

SEQ ID NO: 4930 - protein, 15 aa, Homo sapiens
DFTYDQVAFNGLPQF

SEQ ID NO: 4931 - protein, 15 aa, Homo sapiens
DKIRGEGMRYIIILD

SEQ ID NO: 4932 - protein, 15 aa, Mycobacterium avium
ERPLKQIAFNGGLEP

SEQ ID NO: 4933 - protein, 15 aa, Homo sapiens
GRGNGDPGGGMEKDG

SEQ ID NO: 4934 - protein, 15 aa, Mycobacterium avium
LAKLAGGVAVICAGA

SEQ ID NO: 4935 - protein, 15 aa, Homo sapiens
LAKLGGAGQAARAGT

SEQ ID NO: 4936 - protein, 14 aa, Homo sapiens
NEHPVFAYLKDKLP

SEQ ID NO: 4937 - protein, 15 aa, Mycobacterium avium
QLELTEGMRFDKGYI

SEQ ID NO: 4938 - protein, 11 aa, unidentified
  REGION 1..11: note = epitope involved in Crohn's disease
CNLWEVMHGTC

SEQ ID NO: 4939 - protein, 11 aa, unidentified
  REGION 1..11: note = epitope involved in Crohn's disease
CSIGEALSHGC

SEQ ID NO: 4940 - protein, 9 aa, unidentified
  REGION 1..9: note = epitope involved in Crohn's disease
PWATLVAES

SEQ ID NO: 4941 - protein, 9 aa, unidentified
  REGION 1..9: note = epitope involved in Crohn's disease
TMWDALEAP

SEQ ID NO: 4942 - protein, 15 aa, Mycobacterium avium
TCRRMLAFLKDKENR

SEQ ID NO: 4943 - protein, 5 aa, Homo sapiens
PKKAK

SEQ ID NO: 4944 - protein, 15 aa, Mycobacterium avium
AGDLSKVDAKQPGDY

SEQ ID NO: 4945 - protein, 15 aa, Homo sapiens
CQALVRMLAKKPGWK

SEQ ID NO: 4946 - protein, 15 aa, Homo sapiens
DFTYDQVAFNGLPQF

SEQ ID NO: 4947 - protein, 15 aa, Homo sapiens
DKIRGEGMRYIIILD

SEQ ID NO: 4948 - protein, 15 aa, Mycobacterium avium
ERPLKQIAFNGGLEP

SEQ ID NO: 4949 - protein, 15 aa, Homo sapiens
GRGNGDPGGGMEKDG

SEQ ID NO: 4950 - protein, 14 aa, Homo sapiens
NEHPVFAYLKDKLP

SEQ ID NO: 4951 - protein, 15 aa, Mycobacterium avium
QLELTEGMRFDKGYI

SEQ ID NO: 4952 - protein, 9 aa, Homo sapiens
AHWSGHCCL

SEQ ID NO: 4953 - protein, 15 aa, Mycobacterium avium
TCRRMLAFLKDKENR

SEQ ID NO: 4954 - protein, 5 aa, Homo sapiens
PKKAK

SEQ ID NO: 4955 - protein, 15 aa, Mycobacterium avium
AGDLSKVDAKQPGDY

SEQ ID NO: 4956 - protein, 15 aa, Homo sapiens
CQALVRMLAKKPGWK

SEQ ID NO: 4957 - protein, 15 aa, Homo sapiens
DFTYDQVAFNGLPQF

SEQ ID NO: 4958 - protein, 15 aa, Homo sapiens
DKIRGEGMRYIIILD

SEQ ID NO: 4959 - protein, 15 aa, Mycobacterium avium
ERPLKQIAFNGGLEP

SEQ ID NO: 4960 - protein, 15 aa, Homo sapiens
GRGNGDPGGGMEKDG

SEQ ID NO: 4961 - protein, 14 aa, Homo sapiens
NEHPVFAYLKDKLP

SEQ ID NO: 4962 - protein, 15 aa, Mycobacterium avium
QLELTEGMRFDKGYI

SEQ ID NO: 4963 - protein, 9 aa, Homo sapiens
AHWSGHCCL

SEQ ID NO: 4964 - protein, 15 aa, Mycobacterium avium
TCRRMLAFLKDKENR

SEQ ID NO: 4965 - protein, 5 aa, Homo sapiens
PKKAK

SEQ ID NO: 4966 - protein, 15 aa, Mycobacterium avium
AGDLSKVDAKQPGDY

SEQ ID NO: 4967 - protein, 15 aa, Homo sapiens
CQALVRMLAKKPGWK

SEQ ID NO: 4968 - protein, 15 aa, Homo sapiens
DFTYDQVAFNGLPQF

SEQ ID NO: 4969 - protein, 15 aa, Homo sapiens
DKIRGEGMRYIIILD

SEQ ID NO: 4970 - protein, 15 aa, Mycobacterium avium
ERPLKQIAFNGGLEP

SEQ ID NO: 4971 - protein, 15 aa, Homo sapiens
GRGNGDPGGGMEKDG

SEQ ID NO: 4972 - protein, 14 aa, Homo sapiens
NEHPVFAYLKDKLP

SEQ ID NO: 4973 - protein, 15 aa, Mycobacterium avium
QLELTEGMRFDKGYI

SEQ ID NO: 4974 - protein, 9 aa, Homo sapiens
AHWSGHCCL

SEQ ID NO: 4975 - protein, 304 aa, Homo sapiens
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 4976 - protein, 203 aa, Homo sapiens [sequence omitted]

SEQ ID NO: 4977 - protein, 277 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 4978 - protein, 295 aa, Homo sapiens [sequence omitted]

SEQ ID NO: 4979 - protein, 323 aa, Homo sapiens
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 4980 - protein, 582 aa, Homo sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESKEVSTLESH

SEQ ID NO: 4981 - protein, 110 aa, Homo sapiens
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 4982 - protein, 180 aa, Homo sapiens
IAPVFVLMEQITLKKMRKIVGWSNKDGDGIFSPGGAISNMYSIMAARYKYFPEVKTKGMAAVPKLVLFTSEHSHYSIKKAGAALGFGTDNVILIKCNERGKIIPADLEAKILDAKQKGYVPLYVNATAGTTVYGAFDPIQEIADICEKYNLWLHVDAAWGGGLLMSRKHRHKLSGIERAN

SEQ ID NO: 4983 - protein, 296 aa, Triticum urartu
MKTFLILALLAIVATTATTAVRVPVPQPQPQNPSQPQPQRQVPLVQQQQFPGQQQQFPPQQPYPQPQPFPSQQPYLQLQPFPQPQPFPPQLPYPQPPPFSPQQPYPQPQPQYPQPQQPISQQQAQQQQQQQQQQQQQQQQQQILPQILQQQLIPCRDVVLQQHNIAHARSQVLQQSTYQPLQQLCCQQLWQIPEQSRCQAIHNVVHAIILHQQQQQQQPSSQVSLQQPQQQYPSGQGFFQPSQQNPQAQGSVQPQQLPQFEEIRNLALQTLPRMCNVYIPPYCSTTTAPFGIFGTN

SEQ ID NO: 4984 - protein, 275 aa, Triticum durum
MNIQVDPSSQVQWPQQQPFLQPHQPFSQQPQQIFPQPQQTFPHQPQQQFPQPQQPQRQFLQPRQPFPQQPQQPYPQQPQQPFPQTQQPQQPFPQSKQPQQPFPQPQQPQQSFPQQQPSLIQQSLQQQLNPCKNFLLQQCKPVSLVSSLWSIILPPSDCQVMRQQCCQQLAQIPQQLQCAAIHSVVHSIIMQQEQQEQLQGVQILVPLSQQQQVGQGILVQGQGIIQPQQPAQLEVIRSLVLQTLPTMCNVYVPPYCSTIRAPFASIVAGIGGQYR

SEQ ID NO: 4985 - protein, 282 aa, Triticum aestivum
MNIQVDPSSQVPWPQQQPFPQPHQPFSQQPQQTFPQPQQTFPHQPQQQFSQPQQPQQQFIQPQQPFPQQPQQTYPQRPQQPFPQTQQPQQPFPQSQQPQQPFPQPQQQFPQPQQPQQSFPQQQPSLIQQSLQQQLNPCKNFLLQQCKPVSLVSSLWSMILPRSDCQVMRQQCCQQLAQIPQQLQCAAIHSIVHSIIMQQEQQEQRQGVQILVPLSQQQQVGQGTLVQGQGIIQPQQPAQLEVIRSLVLQTLATMCNVYVPPYCSTIRAPFASIVAGIGGQYR

SEQ ID NO: 4986 - protein, 9 aa, Triticum sp.
PFPQPELPY

SEQ ID NO: 4987 - protein, 9 aa, Triticum sp.
PYPQPELPY

SEQ ID NO: 4988 - protein, 9 aa, Triticum sp.
PQPELPYPW

SEQ ID NO: 4989 - protein, 10 aa, Triticum sp.
FRPPEQPYPQ

SEQ ID NO: 4990 - protein, 9 aa, Triticum sp.
PQQSFPEQQ

SEQ ID NO: 4991 - protein, 9 aa, Triticum sp.
IQPEQPAQL

SEQ ID NO: 4992 - protein, 9 aa, Triticum sp.
QQPEQPYPQ

SEQ ID NO: 4993 - protein, 9 aa, Triticum sp.
SQPEQEFPQ

SEQ ID NO: 4994 - protein, 9 aa, Triticum sp.
PQPEQEFPQ

SEQ ID NO: 4995 - protein, 9 aa, Triticum sp.
QQPEQPFPQ

SEQ ID NO: 4996 - protein, 9 aa, Triticum sp.
PQPEQPFCQ

SEQ ID NO: 4997 - protein, 9 aa, Triticum sp.
QQPFPEQPQ

SEQ ID NO: 4998 - protein, 9 aa, Triticum sp.
PFPQPEQPF

SEQ ID NO: 4999 - protein, 9 aa, Triticum sp.
PQPEQPFPW

SEQ ID NO: 5000 - protein, 9 aa, Triticum sp.
PFSEQEQPV

SEQ ID NO: 5001 - protein, 9 aa, Triticum sp.
FSQQQESPF

SEQ ID NO: 5002 - protein, 9 aa, Triticum sp.
PFPQPEQPF

SEQ ID NO: 5003 - protein, 9 aa, Triticum sp.
PQPEQPFPQ

SEQ ID NO: 5004 - protein, 9 aa, Triticum sp.
PIPEQPQPY

SEQ ID NO: 5005 - protein, 9 aa, Triticum sp.
PFPQPEQPF

SEQ ID NO: 5006 - protein, 9 aa, Triticum sp.
PQPEQPFPQ

SEQ ID NO: 5007 - protein, 9 aa, Triticum sp.
PYPEQEEPF

SEQ ID NO: 5008 - protein, 9 aa, Triticum sp.
PYPEQEQPF

SEQ ID NO: 5009 - protein, 9 aa, Triticum sp.
PFSEQEQPV

SEQ ID NO: 5010 - protein, 9 aa, Triticum sp.
EGSFQPSQE

SEQ ID NO: 5011 - protein, 9 aa, Triticum sp.
EQPQQPFPQ

SEQ ID NO: 5012 - protein, 9 aa, Triticum sp.
EQPQQPYPE

SEQ ID NO: 5013 - protein, 9 aa, Triticum sp.
QFYYPTSPQ

SEQ ID NO: 5014 - protein, 9 aa, Triticum sp.
EGSFQPSQE

SEQ ID NO: 5015 - protein, 9 aa, Triticum sp.
PQQSFPEQE

SEQ ID NO: 5016 - protein, 9 aa, Triticum sp.
QFYYPTSPQ

SEQ ID NO: 5017 - protein, 239 aa, Homo sapiens; identical to SEQ ID NO: 4577

SEQ ID NO: 5018 - protein, 20 aa, Homo sapiens
SPATWTTRGFVFTRHSQTTA

SEQ ID NO: 5019 - protein, 21 aa, Homo sapiens
VFTRHSQTTAIPSCPEGTVPL

SEQ ID NO: 5020 - protein, 20 aa, Homo sapiens
IPSCPEGTVPLYSGFSFLFV

SEQ ID NO: 5021 - protein, 20 aa, Homo sapiens
LYSGFSFLFVQGNQRAHGQD

SEQ ID NO: 5022 - protein, 20 aa, Homo sapiens
FTTMPFLFCNVNDVCNFASR

SEQ ID NO: 5023 - protein, 21 aa, Homo sapiens
VNDVCNFASRNDYSYWLSTPA

SEQ ID NO: 5024 - protein, 20 aa, Homo sapiens
TGRALEPYISRCTVCEGPAI

SEQ ID NO: 5025 - protein, 19 aa, Homo sapiens
RCTVCEPAIAIAVHSQTTD

SEQ ID NO: 5026 - protein, 20 aa, Homo sapiens
IPPCPHGWISLWKGFSFIMF

SEQ ID NO: 5027 - protein, 20 aa, Homo sapiens
LWKGFSFIMFTSAGSEGTQG

SEQ ID NO: 5028 - protein, 20 aa, Homo sapiens
NSYSFWLASLNPERMFRKPI

SEQ ID NO: 5029 - protein, 19 aa, Mus musculus
ATGTRMRGFIFTRHSTTAI

SEQ ID NO: 5030 - protein, 20 aa, Mus musculus
FIFTRHSQTTAIPSCPEGTQ

SEQ ID NO: 5031 - protein, 20 aa, Mus musculus
TTAIPSCPEGTQPLYSGFSL

SEQ ID NO: 5032 - protein, 20 aa, Mus musculus
EGTQPLYSGFSLLFVQGNKR

SEQ ID NO: 5033 - protein, 20 aa, Mus musculus
FLFCNINNVCNFASRNDYSY

SEQ ID NO: 5034 - protein, 20 aa, Mus musculus
VCNFASRNDYSYWLSTPALM

SEQ ID NO: 5035 - protein, 20 aa, Mus musculus
APISGRALEPYISRCTVCEG

SEQ ID NO: 5036 - protein, 20 aa, Mus musculus
EPYISRCTVCEGPAMAIAVH

SEQ ID NO: 5037 - protein, 20 aa, Mus musculus
AIPPCPQDWVSLWKGFSFIM

SEQ ID NO: 5038 - protein, 21 aa, Mus musculus
WVSLWKGEFSFIMFTSAGSEG

SEQ ID NO: 5039 - protein, 20 aa, Mus musculus
SFWLASLNPERMFRKPIPST

SEQ ID NO: 5040 - protein, 20 aa, Triticum sp.
PQPFPPQLPYPQPQLPYPQP

SEQ ID NO: 5041 - protein, 20 aa, Triticum sp.
MQLQPFPQPQLPYPQPQLPY

SEQ ID NO: 5042 - protein, 20 aa, Triticum sp.
QPFPQPQQPFPWQPQQPFPQ

SEQ ID NO: 5043 - protein, 20 aa, Triticum sp.
PQQPQQPFPQPQQPIPVQPQ

SEQ ID NO: 5044 - protein, 20 aa, Triticum sp.
PQQQQPFPQPQQPFSQQPQQ

SEQ ID NO: 5045 - protein, 20 aa, Triticum sp.
QQPQQPFPQPQLPFPQQSEQ

SEQ ID NO: 5046 - protein, 20 aa, Triticum sp.
WPQQQPFPQPQQPFCQQPQQ

SEQ ID NO: 5047 - protein, 20 aa, Triticum sp.
LQLQPFPQPQLPYSQPQPFR

SEQ ID NO: 5048 - protein, 20 aa, Triticum sp.
LQPFPQPQPFLPQLPYPQPQ

SEQ ID NO: 5049 - protein, 20 aa, Triticum sp.
SQQPQQQFSQPQQQFPQPQQ

SEQ ID NO: 5050 - protein, 20 aa, Triticum sp.
QAFPQPQQTFPHQPQQQFPQ

SEQ ID NO: 5051 - protein, 20 aa, Triticum sp.
CKVFLQQQCSPVAMPQRLAR

SEQ ID NO: 5052 - protein, 20 aa, Triticum sp.
LQLQPFPQPQLPYLQPQPFR

SEQ ID NO: 5053 - protein, 20 aa, Triticum sp.
QQQFIQPQQPFPQQPQQTYP

SEQ ID NO: 5054 - protein, 20 aa, Triticum sp.
SHIPGLERPWQQQPLPPQQT

SEQ ID NO: 5055 - protein, 20 aa, Triticum sp.
SQQPQQPFPQPQQQFPQPQQ

SEQ ID NO: 5056 - protein, 20 aa, Triticum sp.
QQPFPQPQQPQLPFPQQPQQ

SEQ ID NO: 5057 - protein, 20 aa, Triticum sp.
PQLPYPQPQLPYPQPQPFRP

SEQ ID NO: 5058 - protein, 20 aa, Triticum sp.
QPFPQPQQPFPWQPQQPFPQ

SEQ ID NO: 5059 - protein, 20 aa, Triticum sp.
FPELQQPIPQQPQQPFPLQP

SEQ ID NO: 5060 - protein, 20 aa, Triticum sp.
QGQQGYYPISPQQSGQGQQP

SEQ ID NO: 5061 - protein, 20 aa, Triticum sp.
LQPGQGQPGYYPTSPQQIGQ

SEQ ID NO: 5062 - protein, 20 aa, Triticum sp.
QQFLQPQQPFPQQPQQPYPQ

SEQ ID NO: 5063 - protein, 20 aa, Triticum sp.
PGQGQSGYYPTSPQQSGQKQ

SEQ ID NO: 5064 - protein, 20 aa, Triticum sp.
TPIQPQQPFPQQPQQPQQPF

SEQ ID NO: 5065 - protein, 20 aa, Triticum sp.
PQQPQQPFPLQPQQPFPQQP

SEQ ID NO: 5066 - protein, 20 aa, Triticum sp.
PFTQPQQPTPIQPQQPFPQQ

SEQ ID NO: 5067 - protein, 20 aa, Triticum sp.
PQQPFPQPQQTFPQQPQLPF

SEQ ID NO: 5068 - protein, 20 aa, Triticum sp.
GQGQSGYYPTSPQQSGQEAT

SEQ ID NO: 5069 - protein, 20 aa, Triticum sp.
PLQPQQPFPQQPQQPFPQPQ

SEQ ID NO: 5070 - protein, 20 aa, Triticum sp.
QPFPQLQQPQQPLPQPQQPQ

SEQ ID NO: 5071 - protein, 20 aa, Triticum sp.
QQPFPQQPQQPFPQPQQPIP

SEQ ID NO: 5072 - protein, 20 aa, Triticum sp.
PQQPFPQPQQTFPQQPQLPF

SEQ ID NO: 5073 - protein, 20 aa, Triticum sp.
VAHAIIMHQQQQQQQEQKQQ

SEQ ID NO: 5074 - protein, 20 aa, Triticum sp.
PQQPFPQQPQQQFPQPQQPQ

SEQ ID NO: 5075 - protein, 20 aa, Triticum sp.
QQPAQYEVIRSLVLRTLPNM

SEQ ID NO: 5076 - protein, 20 aa, Triticum sp.
ATANMQVDPSGQVQWPQQQP

SEQ ID NO: 5077 - protein, 20 aa, Hordeum vulgare
QPFPQPQQPFPWQPQQPFPQ

SEQ ID NO: 5078 - protein, 20 aa, Hordeum vulgare
WQPQQPFPQPQQPFPLQPQQ

SEQ ID NO: 5079 - protein, 20 aa, Hordeum vulgare
QPQQPFPQPQQPIPYQPQQP

SEQ ID NO: 5080 - protein, 20 aa, Hordeum vulgare
QPQQPQPFPQQPVPQQPQPY

SEQ ID NO: 5081 - protein, 20 aa, Hordeum vulgare
PQPFPQQPIPQQPQPYPQQP

SEQ ID NO: 5082 - protein, 20 aa, Hordeum vulgare
QQPQPFSQQPIPQQPQPYPQ

SEQ ID NO: 5083 - protein, 20 aa, Hordeum vulgare
QSQQQFPQPQQPFPQQPQQP

SEQ ID NO: 5084 - protein, 20 aa, Hordeum vulgare
PQPFPQQPIPQQPQPYPQQP

SEQ ID NO: 5085 - protein, 20 aa, Hordeum vulgare
QQPFPQQPFPQQPQPYPQQP

SEQ ID NO: 5086 - protein, 20 aa, Hordeum vulgare
PQQPQQPFPQPQQPFSWQPQ

SEQ ID NO: 5087 - protein, 20 aa, Hordeum vulgare
QPQPYPQQPQPYPQQPFQPQ

SEQ ID NO: 5088 - protein, 20 aa, Hordeum vulgare
QQPFPQQPFPQQPQPYPQQP

SEQ ID NO: 5089 - protein, 20 aa, Hordeum vulgare
PQPYPQQPQPFPQQPPFCQQ

SEQ ID NO: 5090 - protein, 20 aa, Hordeum vulgare
FQQPQQSYPVQPQQPFPQPQ

SEQ ID NO: 5091 - protein, 20 aa, Hordeum vulgare
YPQQPQPFPQQPIPQQPQPY

SEQ ID NO: 5092 - protein, 20 aa, Hordeum vulgare
QQQPFPQQPIPQQPQPYPQQ

SEQ ID NO: 5093 - protein, 20 aa, Hordeum vulgare
QPQQPQPFPQQPVPQQPQPY

SEQ ID NO: 5094 - protein, 20 aa, Hordeum vulgare
QPQPFPQQPIPLQPHQPYTQ

SEQ ID NO: 5095 - protein, 20 aa, Hordeum vulgare
LPRPQQPFPWQPQQPFPQPQ

SEQ ID NO: 5096 - protein, 20 aa, Hordeum vulgare
QQPFPLQPQQPFPQPQPFPQ

SEQ ID NO: 5097 - protein, 20 aa, Hordeum vulgare
PFPQQPQQPFPQPQQPFRQQ

SEQ ID NO: 5098 - protein, 20 aa, Hordeum vulgare
PQQPFQPQQPFPQQTIPQQP

SEQ ID NO: 5099 - protein, 20 aa, Hordeum vulgare
NPLQPQQPFPLQPQPPQQPF

SEQ ID NO: 5100 - protein, 20 aa, Hordeum vulgare
NPLQPQQPFPLQPQPPQQPF

SEQ ID NO: 5101 - protein, 20 aa, Hordeum vulgare
PFPQQPQQPFPQPQQPFRQQ

SEQ ID NO: 5102 - protein, 20 aa, Hordeum vulgare
QPQQPFPLQPQQPFPWQPQQ

SEQ ID NO: 5103 - protein, 20 aa, Hordeum vulgare
TFPPSQQPNPLQPQQPFPLQ

SEQ ID NO: 5104 - protein, 20 aa, Hordeum vulgare
PQQTIPQQPQQPFPLQPQQP

SEQ ID NO: 5105 - protein, 20 aa, Hordeum vulgare
QPQQPFSFSQQPQQPFPLQP

SEQ ID NO: 5106 - protein, 20 aa, Hordeum vulgare
QQPFPQQPFPQQPQPYPQQP

SEQ ID NO: 5107 - protein, 20 aa, Secale cereale
QQLPLQPQQPFPQPQQPIPQ

SEQ ID NO: 5108 - protein, 20 aa, Secale cereale
SIPQPQQPFPQPQQPFPQSQ

SEQ ID NO: 5109 - protein, 20 aa, Secale cereale
QPFPQPQQPTPIQPQQPFPQ

SEQ ID NO: 5110 - protein, 20 aa, Secale cereale
QPFPQPQQPTPIQPQQPFPQ

SEQ ID NO: 5111 - protein, 20 aa, Secale cereale
PAPIQPQQPFPQQPQQPFPQ

SEQ ID NO: 5112 - protein, 20 aa, Secale cereale
PQQPFPQQPEQIIPQQPQQP

SEQ ID NO: 5113 - protein, 20 aa, Secale cereale
QYSPYQPQQPFPQPQQPTPI

SEQ ID NO: 5114 - protein, 20 aa, Secale cereale
SQQPQRPQQPFPQQPQQIIP

SEQ ID NO: 5115 - protein, 20 aa, Secale cereale
QQLPLQPQQPFPQPQQPIPQ

SEQ ID NO: 5116 - protein, 20 aa, Secale cereale
FPLQPQQPFPQQPEQIISQQ

SEQ ID NO: 5117 - protein, 20 aa, Secale cereale
PQQPFPQQPEQIIPQQPQQP

SEQ ID NO: 5118 - protein, 20 aa, Secale cereale
FPQQPQQPFPQPQQQLPLQP

SEQ ID NO: 5119 - protein, 20 aa, Secale cereale
SPQPQQPYPQQPFPQQPQQP

SEQ ID NO: 5120 - protein, 20 aa, Secale cereale
QQPQQPFPLQPQQPVPQQPQ

SEQ ID NO: 5121 - protein, 20 aa, Secale cereale
QPQQIIPQQPQQPFPLQPQQ

SEQ ID NO: 5122 - protein, 20 aa, Secale cereale
PQQPFPQQPEQIIPQQPQQP

SEQ ID NO: 5123 - protein, 20 aa, Secale cereale
QTQQSIPQPQQPFPQPQQPF

SEQ ID NO: 5124 - protein, 20 aa, Secale cereale
QQPFLLQPQQPFSQPQQPFL

SEQ ID NO: 5125 - protein, 20 aa, Secale cereale
QQPQQPFPLQPQQPVPQQPQ

SEQ ID NO: 5126 - protein, 20 aa, Secale cereale
EQIISQQPFPLQPQQPFSQP

SEQ ID NO: 5127 - protein, 20 aa, Secale cereale
NMQVGPSGQVEWPQQQPLPQ

SEQ ID NO: 5128 - protein, 20 aa, Secale cereale
PQQLFPLPQQPFPQPQQPFP

SEQ ID NO: 5129 - protein, 20 aa, Secale cereale
PQTQQPQQPFPQPQQPQQLF

SEQ ID NO: 5130 - protein, 20 aa, Secale cereale
SPQQPQLPFPQPQQPFVVVV

SEQ ID NO: 5131 - protein, 20 aa, Secale cereale
FPQQPEQIISQQPQQPFPLQ

SEQ ID NO: 5132 - protein, 20 aa, Secale cereale
PAPIQPQQPFPQQPQQPFPQ

SEQ ID NO: 5133 - protein, 20 aa, Secale cereale
PQEPQQLFPQSQQPQQPFPQ

SEQ ID NO: 5134 - protein, 20 aa, Secale cereale
SPQPQQPYPQQPFPQQPQQP

SEQ ID NO: 5135 - protein, 20 aa, Secale cereale
PTPIQPQQPFPQRPQQPFPQ

SEQ ID NO: 5136 - protein, 15 aa, synthetic construct
  REGION 1..15: note = NPL033
LQPFPQPELPYPQPQ

SEQ ID NO: 5137 - protein, 14 aa, synthetic construct
  REGION 1..14: note = NPL038
QPFPQPEQPFPWQP

SEQ ID NO: 5138 - protein, 15 aa, synthetic construct
  REGION 1..15: note = NPL034
PEQPIPEQPQPYPQQ

SEQ ID NO: 5139 - protein, 16 aa, synthetic construct
  REGION 1..16: note = gluten derived peptide
PQQPFPQPEQPFPWQP

SEQ ID NO: 5140 - protein, 16 aa, synthetic construct
  REGION 1..16: note = gluten derived peptide
FPEQPIPEQPQPYPQQ

What is claimed:

1. A composition comprising one or more antigens covalently attached to a polymeric carrier particle, wherein said one or more antigens are encapsulated in said particle by covalent attachment to the internal particle surfaces, and, optionally wherein said antigens are further attached to the surface of the polymeric particle, and wherein the zeta potential of the particle is from about −100 mV to about −15 mV and the particle has an average diameter between about 0.3 μm to about 5 μm.

2. The composition of claim 1, wherein the zeta potential of the particle is from about −80 mV to about −30 mV.

3. The composition of claim 1, wherein the particle comprises a co-polymer having a molar ratio from about 50:50, 80:20 to about 100:0.

4. The composition of claim 1, wherein the particle comprises a poly(lactide-co-glycolide) (PLG) particle, a polylactic acid (PLA) particle or a poly(lactic-co-glycolic acid) particle.

5. The composition of claim 1, wherein the particle has an average diameter of between about 400 to about 800 nanometers 0.1 μm to about 10 μm.

6. The composition of claim 1, wherein said one or more antigens comprises an autoimmune antigen, an antigen expressed on a tissue to be transplanted into a subject, an enzyme for enzyme replacement therapy, viral and/or bacterial protein, or an allergen.

7. The composition of claim 6, wherein said one or more antigens comprises at least a portion of a protein selected from the group consisting of: myelin basic protein, acetylcholine receptor, endogenous antigen, myelin oligodendrocyte glycoprotein, pancreatic beta-cell antigen, insulin, proinsulin, islet-specific glucose-6-phosphatase catalytic subunit-related protein (IGRP), glutamic acid decarboxylase (GAD), collagen type 11, human cartilage gp39, fp130-RAPS, proteolipid protein, fibrillarin, small nucleolar protein, thyroid stimulating factor receptor, histones, glycoprotein gp70, pyruvate dehydrogenase dehydrolipoamide acetyltransferase (PCD-E2), hair follicle antigen, A-gliaden, gliaden, insulin, proinsulin, islet-specific glucose-6-phosphatase catalytic subunit-related protein (IGRP), human tropomyosin isoform 5, Bahia grass pollen (BaGP), peach allergen Pru p 3, alpha s 1-Caein Milk allergen, Apig1 celery allergen, Bere1 Brazil nut allergen, B-Lactoglobulin Milk allergen, Bovine serum albumin, Cor a 1.04 Hazelnut allergen, myelin associated glycoprotein, aquaporin, α3 chain of type IV collagen, Ovalbumin Egg allergen, Advate, antihemophilic factor, Kogenate, Eloctate, recombinant factor VIII Fc fusion protein, Refacto, Novo VIIa, recombinant factor VII, eptacog alfa, Helixate, Monanine, Coagulation Factor IX, Wilate, Ceredase, Alglucerase, Cerezyme, Imiglucerase, Elelso, taliglucerase alfa, Fabrazyme, Agalsidase beta, Aldurazyme, −I-iduronidase, Myozyme, Acid-glucosidase, Elaprase, iduronate-2-sulfatase, Naglazyme arylsufatase B, or N-acetylgalactosamine-4-sulfatase.

8. The composition of claim 1, wherein said one or more antigens comprises one or more epitopes.

9. The composition of claim 8, wherein the one or more epitopes is associated with an allergy, an autoimmune disease, an enzyme used in enzyme replacement therapy, lysosomal storage disease, or an inflammatory disease or disorder.

10. The composition of claim 9, wherein the one or more epitopes is associated with rheumatoid arthritis, scleroderma, Sjogren's disease, vitiliqo, alopecia (baldness), Grave's disease, pemphigus foliaceus, autoimmune hepatitis including that associated with hepatitis B virus (HBV) and hepatitis C virus (HCV), hypopituitarism, graft-versus-host disease (GvHD), myocarditis, uveitis, pernicious anemia, Hashimoto's thyroiditis, Type I and Type II autoimmune polyglandular syndromes, dermatitis herpetiformis, linear IgA disease, epidermolysis bullosa acquisita, erythema nodosa, pemphigoid gestationis, cicatricial pemphigoid, chronic bullous disease of childhood, hemolytic anemia, thrombocytopenic purpura, Goodpasture's syndrome, autoimmune neutropenia, Eaton-Lambert myasthenic syndrome, stiff-man syndrome, acute disseminated encephalomyelitis, Guillain-Barre syndrome, chronic inflammatory demyelinating polyradiculoneuropathy, multifocal motor neuropathy with conduction block, chronic neuropathy with monoclonal gammopathy, opsonoclonus-myoclonus syndrome, cerebellar degeneration, encephalomyelitis, retinopathy, primary biliary sclerosis, sclerosing cholangitis, gluten-sensitive enteropathy, ankylosing spondylitis, reactive arthritides, polymyositis/dermatomyositis, mixed connective tissue disease, Bechet's syndrome, psoriasis, allergic angiitis and granulomatosis (Churg-Strauss disease), polyangiitis overlap syndrome, hypersensitivity vasculitis, Wegener's granulomatosis, temporal arteritis, Takayasu's arteritis, Kawasaki's disease, isolated vasculitis of the central nervous system, thromboangiitis obliterans, sarcoidosis, glomerulonephritis, cryopathies, type 1 diabetes, multiple sclerosis, Systemic Lupus, Neuromyelitis Optica, Idiopathic Thrombocytopenic Purpura, Thrombotic Thrombocytopenic Purpura, Membranous Nephropathy, Bullous Phemphigoid, Phemphigus Vulgaris, Myasthenia Gravis, a mucopolysaccharide storage disorder, gangliosidosis, alkaline hypophosphatasia, cholesterol ester storage disease, hyperuricemia, growth hormone deficiency, renal anemia, Gaucher's disease, Fabry's disease, Hurler's disease, Hunter's disease, Maroteaux-Lamy disease, hemophilia A, hemophilia B, von Wilebrand disease, venous thrombosis, purpura fulminans, mucopolysaccaridosis VI, pompe disease, Celiac's disease, or inflammatory bowel disease, including Crohn's disease ulcerative colitis, myozyme, alglucerase, imiglucerase, taliglucerase, agalsidase beta, I-iduronidase, acid glucosidase, Iduronate-2-sulfatase, N-acetygalactosamnie-4-sulfatase, antihemophilic factor, factor VII, eptacogalfa, factor IX, miglustat, romiplastim, epoetin alpha, protein C, laronidase, or lumizyme Factor VIII.

11. The composition of claim 1, further comprising a pharmaceutically acceptable carrier.

12. A method of inducing antigen-specific tolerance in a subject comprising: administering to said subject an effective amount of a composition of claim 1.

13. The method of claim 12, wherein said administering is performed to treat or prevent a disease or condition.

14. The method of claim 13, wherein said disease or condition is selected from the group consisting of: an autoimmune disease, a lysosomal storage disease, an enzyme deficiency, inflammatory disease, an allergy, transplantation rejection, and a hyperimmune response.

15. The method of claim 14, wherein said disease or condition is selected from the group consisting of: rheumatoid arthritis, scleroderma, Sjogren's disease, vitiliqo, alopecia (baldness), Grave's disease, pemphigus foliaceus, autoimmune hepatitis including that associated with hepatitis B virus (HBV) and hepatitis C virus (HCV), hypopituitarism, graft-versus-host disease (GvHD), myocarditis, uveitis, pernicious anemia, Hashimoto's thyroiditis, Type I and Type II autoimmune polyglandular syndromes, dermatitis herpetiformis, linear IgA disease, epidermolysis bullosa acquisita, erythema nodosa, pemphigoid gestationis, cicatricial pemphigoid, chronic bullous disease of childhood, hemolytic anemia, thrombocytopenic purpura, Goodpasture's syndrome, autoimmune neutropenia, Eaton-Lambert myasthenic syndrome, stiff-man syndrome, acute disseminated encephalomyelitis, Guillain-Barre syndrome, chronic inflammatory demyelinating polyradiculoneuropathy, multifocal motor neuropathy with conduction block, chronic neuropathy with monoclonal gammopathy, opsonoclonus-myoclonus syndrome, cerebellar degeneration, encephalomyelitis, retinopathy, Primary biliary sclerosis, sclerosing cholangitis, gluten-sensitive enteropathy, ankylosing spondylitis, reactive arthritides, polymyositis/dermatomyositis, mixed connective tissue disease, Bechet's syndrome, psoriasis, allergic angiitis and granulomatosis (Churg-Strauss disease), polyangiitis overlap syndrome, hypersensitivity vasculitis, Wegener's granulomatosis, temporal arteritis, Takayasu's arteritis, Kawasaki's disease, isolated vasculitis of the central nervous system, thromboangiitis obliterans, sarcoidosis, glomerulonephritis, cryopathies, multiple sclerosis, type 1 diabetes, asthma, a food allergy, an environmental allergy, Celiac disease, inflammatory bowel disease, including Crohn's disease and ulcerative colitis, a mucopolysaccharide storage disorder, gangliosidosis, alkaline hypophosphatasia, cholesterol ester storage disease, hyperuricemia, growth hormone deficiency, renal anemia Hemophilia, Hemophilia A, Hemophilia B, von Willebrand disease, Gaucher's Disease, Fabry's Disease, Hurler's Disease, Pompe's Disease, Hunter's Disease, Maroteaux-Lary Disease and a condition caused by said antigen in said subject to reduce overreaction to said antigen.

16. The method of claim 12, wherein said composition is administered intravenously.

17. A method of inducing regulatory T cells comprising treating said T cells with an effective amount of a composition of claim 1, wherein the particle size is greater than 80 nm.

18. A process for the preparation of a tolerizing immune modified particle (TIMP) of claim 1, said process comprising:
 a) covalently linking one or more carrier polymers with one or more antigens to form carrier polymer-antigen conjugates; and
 b) contacting the carrier polymer-antigen conjugates with a solution under conditions effective to form the TIMP, wherein the TIMP having one or more antigens encapsulated in the TIMP by covalent attachment to the internal particle surfaces, is formed.

19. The process of claim 18, wherein the zeta potential of the particle is from about −80 mV to about −30 mV.

20. The process of claim 18, wherein said one or more antigens comprises an autoimmune antigen, an antigen expressed on a tissue to be transplanted into a subject, an enzyme for enzyme replacement therapy, viral and/or bacterial protein, or an allergen.

* * * * *